(12) United States Patent
Heard et al.

(10) Patent No.: US 9,856,297 B2
(45) Date of Patent: Jan. 2, 2018

(54) PLANT TRANSCRIPTIONAL REGULATORS

(71) Applicant: Mendel Biotechnology, Inc., Hayward, CA (US)

(72) Inventors: Jacqueline E Heard, Wenham, MA (US); Jose Luis Riechmann, Barcelona (ES); Robert A Creelman, Castro Valley, CA (US); Oliver J Ratcliffe, Oakland, CA (US); Roger D Canales, Berlin (DE); Peter P Repetti, Emeryville, CA (US); Roderick W Kumimoto, Sacramento, CA (US); Neal I Gutterson, Oakland, CA (US); T. Lynne Reuber, San Mateo, CA (US); Omaira Pineda, Vero Beach, FL (US); Cai-Zhong Jiang, Davis, CA (US); Karen S Century, Chapel Hill, NC (US); Luc Adam, Hayward, CA (US); James Z Zhang, Palo Alto, CA (US); Frederick D Hempel, Sunol, CA (US); Jeffrey M Libby, Cupertino, CA (US)

(73) Assignee: Mendel Biotechnology, Inc., Hayward, CA (US)

( * ) Notice: Subject to any disclaimer, the term of this patent is extended or adjusted under 35 U.S.C. 154(b) by 498 days.

(21) Appl. No.: 14/229,574

(22) Filed: Mar. 28, 2014

(65) Prior Publication Data

US 2015/0013030 A1 Jan. 8, 2015

Related U.S. Application Data

(60) Division of application No. 14/167,768, filed on Jan. 29, 2014, now abandoned, which is a division of application No. 12/705,845, filed on Feb. 15, 2010, now Pat. No. 8,686,226, which is a continuation-in-part of application No. 11/435,388, filed on May 15, 2006, now Pat. No. 7,663,025, which is a continuation-in-part of application No. PCT/US2004/037584, filed on Nov. 12, 2004, which is a continuation-in-part of application No. 10/714,887, filed on Nov. 13, 2003, now abandoned, said application No. 12/705,845 is a continuation-in-part of application No. 10/714,887, filed on Nov. 13, 2003, now abandoned, which is a continuation-in-part of application No. 10/412,699, filed on Apr. 10, 2003, now Pat. No. 7,345,217, which is a continuation-in-part of application No. 09/506,720, filed on Feb. 17, 2000, now abandoned, and a continuation-in-part of application No. 09/394,519, filed on Sep. 13, 1999, now abandoned, and a continuation-in-part of application No. 09/533,392, filed on Mar. 22, 2000, now abandoned, and a continuation-in-part of application No. 09/533,029, filed on Mar. 22, 2000, now Pat. No. 6,664,446, and a continuation-in-part of application No. 09/532,591, filed on Mar. 22, 2000, now abandoned, and a continuation-in-part of application No. 09/533,030, filed on Mar. 22, 2000, now abandoned, and a continuation-in-part of application No. 09/713,994, filed on Nov. 16, 2000, now (Continued)

(51) Int. Cl.
*C12N 15/82* (2006.01)
*C07K 14/415* (2006.01)

(52) U.S. Cl.
CPC .......... *C07K 14/415* (2013.01); *C12N 15/825* (2013.01); *C12N 15/827* (2013.01); *C12N 15/8216* (2013.01); *C12N 15/8222* (2013.01); *C12N 15/8247* (2013.01); *C12N 15/8251* (2013.01); *C12N 15/8261* (2013.01); *C12N 15/8271* (2013.01); *C12N 15/8273* (2013.01); *C12N 15/8275* (2013.01); *C12N 15/8281* (2013.01); *C12N 15/8282* (2013.01)

(58) Field of Classification Search
None
See application file for complete search history.

(56) References Cited

U.S. PATENT DOCUMENTS

| 7,193,129 B2 | 3/2007 | Reuber et al. |
| 7,223,904 B2 | 5/2007 | Heard et al. |

(Continued)

FOREIGN PATENT DOCUMENTS

| WO | WO-01-35727 A1 | 5/2001 |
| WO | WO-01-36598 A1 | 5/2001 |

(Continued)

OTHER PUBLICATIONS

Seki et al (Monitoring the expression profiles of 7000 Arabidopsis genes under drought, cold and high-salinity stresses using a full-length cDNA microarray. The Plant Journal 31(3), 279-292, 2002).*

(Continued)

*Primary Examiner* — Medina A Ibrahim
*Assistant Examiner* — Wayne Zhong
(74) *Attorney, Agent, or Firm* — Dentons US LLP; David Lanzotti, Esq.

(57) ABSTRACT

The invention relates to plant transcription factor polypeptides, polynucleotides that encode them, homologs from a variety of plant species, and methods of using the polynucleotides and polypeptides to produce transgenic plants having improved tolerance to drought, shade, and low nitrogen conditions, as compared to wild-type or reference plants.

13 Claims, 81 Drawing Sheets

Figure 1:
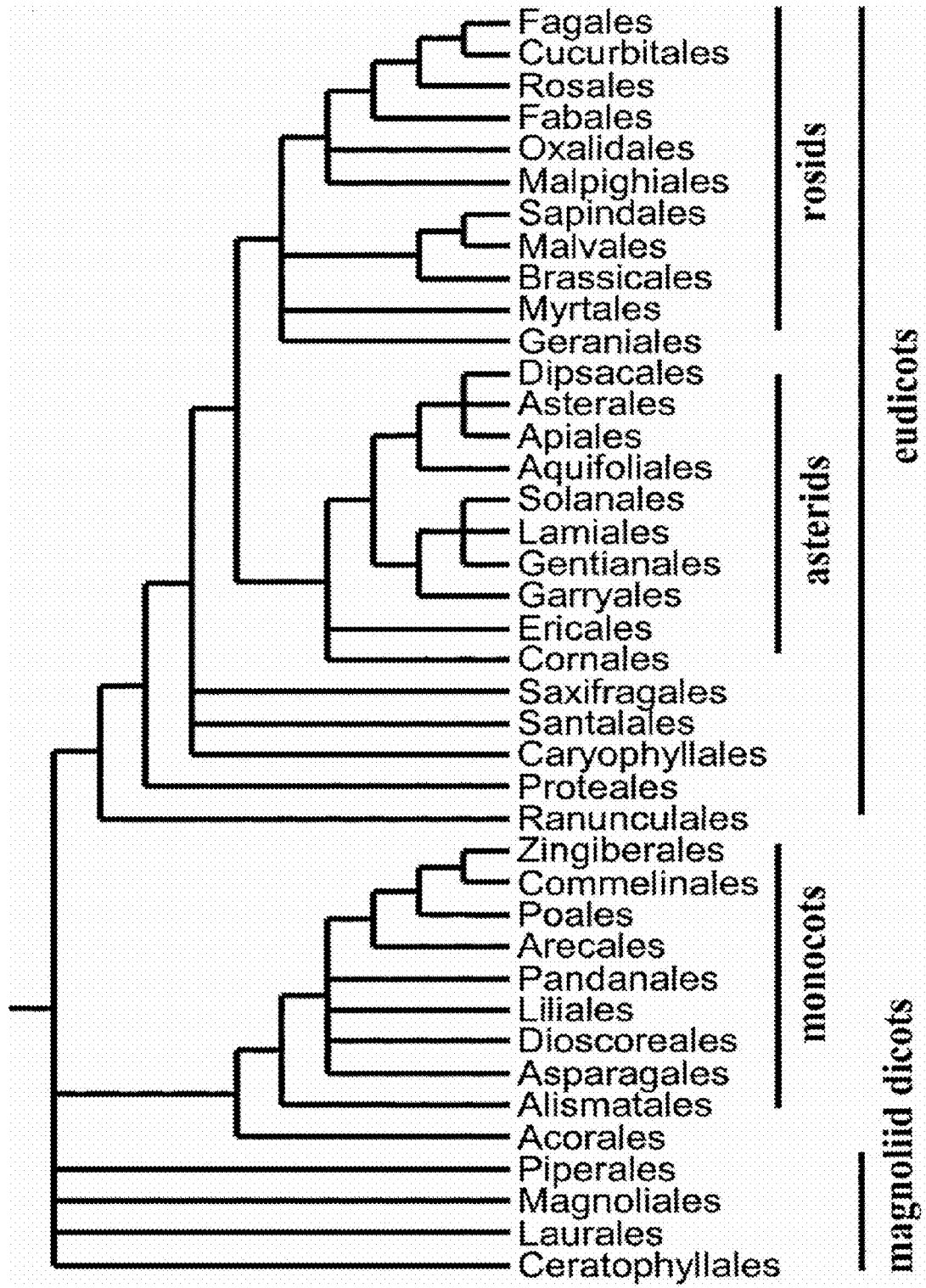

Related U.S. Application Data abandoned, said application No. 10/714,887 is a continuation-in-part of application No. 10/456,882, filed on Jun. 6, 2003, now abandoned, and a continuation-in-part of application No. 09/823,676, filed on Mar. 30, 2001, now Pat. No. 6,717,034, and a continuation-in-part of application No. 09/934,455, filed on Aug. 22, 2001, now abandoned, and a continuation-in-part of application No. 10/112,887, filed on Mar. 18, 2002, now abandoned, and a continuation-in-part of application No. 10/268,264, filed on Oct. 10, 2002, now Pat. No. 6,692,080, and a continuation-in-part of application No. 10/225,066, filed on Aug. 9, 2002, now Pat. No. 7,238,860, and a continuation-in-part of application No. 10/225,067, filed on Aug. 9, 2002, now Pat. No. 7,135,616, and a continuation-in-part of application No. 10/225,068, filed on Aug. 9, 2002, now Pat. No. 7,193,129, and a continuation-in-part of application No. 10/302,267, filed on Nov. 22, 2002, now Pat. No. 7,223,904, and a continuation-in-part of application No. 10/374,780, filed on Feb. 25, 2003, now Pat. No. 7,511,190, which is a continuation-in-part of application No. 09/837,944, filed on Apr. 18, 2001, now abandoned, and a continuation-in-part of application No. 10/171,468, filed on Jun. 14, 2002, now abandoned, said application No. 10/714,887 is a continuation-in-part of application No. 10/666,642, filed on Sep. 18, 2003, now Pat. No. 7,196,245.

(60) Provisional application No. 60/542,928, filed on Feb. 5, 2004, provisional application No. 60/527,658, filed on Dec. 5, 2003, provisional application No. 60/135,134, filed on May 20, 1999, provisional application No. 60/125,814, filed on Mar. 23, 1999, provisional application No. 60/166,228, filed on Nov. 17, 1999, provisional application No. 60/197,899, filed on Apr. 17, 2000, provisional application No. 60/227,439, filed on Aug. 22, 2000, provisional application No. 60/310,847, filed on Aug. 9, 2001, provisional application No. 60/338,692, filed on Dec. 11, 2001, provisional application No. 60/336,049, filed on Nov. 19, 2001, provisional application No. 60/465,809, filed on Apr. 24, 2003, provisional application No. 60/434,166, filed on Dec. 17, 2002, provisional application No. 60/411,837, filed on Sep. 18, 2002.

(56) References Cited

U.S. PATENT DOCUMENTS

| | | |
|---|---|---|
| 7,659,446 B2 | 2/2010 | Sherman et al. |
| 7,960,612 B2 | 6/2011 | Zhang et al. |
| 8,426,678 B2 | 4/2013 | Riechmann et al. |
| 8,541,665 B2 | 9/2013 | Jiang et al. |
| 8,809,630 B2 | 8/2014 | Kumimoto et al. |
| 2003/0131386 A1 | 7/2003 | Samaha et al. |
| 2009/0265813 A1 | 10/2009 | Gutterson et al. |
| 2012/0137382 A1 | 5/2012 | Repetti et al. |

FOREIGN PATENT DOCUMENTS

| | | |
|---|---|---|
| WO | WO-03-014327 A2 | 2/2003 |
| WO | WO-03-014327 A3 | 2/2003 |
| WO | WO-2004-076638 A2 | 9/2004 |
| WO | WO-2005-047516 A2 | 5/2005 |
| WO | WO-2005-047516 A3 | 5/2005 |

OTHER PUBLICATIONS

Salanoubat et al (Sequence and analysis of chromosome 3 of the plant *Arabidopsis thaliana*. Nature. 408 (6814):820-822, Dec. 14, 2000).*

Kasuga et al (Improving plant drought, salt, and freezing tolerance by gene transfer of a single stress-inducible transcription factor. Nature Biotechnology vol. 17 Mar. 1999).*

Pena et al (Constitutive expression of Arabidopsis Leafy or APETALA1 genes in citrus reduces their generation time. Nature Biotechnology. 19:263-267, Mar. 2001).*

Xie et al (Arabidopsis NAC1 transduces auxin signal downstream of TIR1 to promote lateral root development. Genes & Development 14:3024-3036, 2000).*

Guo et al (Protein tolerance to random amino acid change, Proc. Natl. Acad. Sci. USA 101:9205-9210, 2004).*

Guerois et al., "Predicting Changes in the Stability of Proteins and Protein Complexes: A Study of More Than 1000 Mutations," *J. Mol. Biol.* 320:369-387, 2002.

Kumar et al., "Predicting the effects of coding non-synonymous variants on protein function using the SIFT algorithm," *Nature Protocols* 4(8):1073-1082, 2009.

Ng et al., "Predicting the Effects of Amino Acid Substitutions on Protein Function," *Annu. Rev. Genom. Hum. Genet.* 7:61-80, 2006.

Reva etal., "Predicting the functional impact of protein mutations: application to cancer genomics," *Nucleic Acids Research* 39(17):e118, 2011.

Sandhya et al., "CUSP: an algorithm to distinguish structurally conserved and unconserved regions in protein domain alignments and its application in the study of large length variations," *BMC Structural Biology* 8(28):1-14, 2008.

EPO Examination Report for EP 00980417, dated Mar. 23, 2007.
EPO Examination Report for EP 00980417, dated Oct. 10, 2007.
EPO Examination Report for EP 00980417, dated Jun. 11, 2008.
EPO Examination Report for EP 00980417, dated Apr. 27, 2009.
EPO Examination Report for EP 00980417, dated Mar. 5, 2010.
EPO Examination Report for EP 00980417, dated Dec. 16, 2010.
EPO Examination Report for EP 00980417, dated Apr. 20, 2011.
EPO Examination Report for EP 00980417, dated Sep. 8, 2011.
International Search Report for PCT/US2000/031457, dated Mar. 19, 2001.
International Preliminary Examination Report for PCT/US2000/031457, completed Mar. 22, 2002.
International Preliminary Report on Patentability for PCT/US2004/03784, dated Jun. 7, 2006.
Supplementary Partial European Search Report and Annex for EP 00980417, dated Nov. 17, 2004.
Supplementary Partial European Search Report and Annex for EP 00980417, dated Feb. 14, 2005.
Supplementary Partial European Search Report and Annex for EP 04714657, completed Apr. 19, 2007.
Written Opinion for PCT/US2000/031457, dated Dec. 26, 2001.
Written Opinion for PCT/US2004/037584, dated May 1, 2006.
GenBank AC022287.9, *Arabidopsis thaliana* chromosome III BAC T27C4 genomic sequence, complete sequence.

* cited by examiner

| Sequence Name | (SEQ ID NO.) | Sequence |
|---|---|---|
| G2133 | (1019) | DQSKYKGIRRRKWGKWVSEIRVPGTRQRLWLGSFSTAEGAAVAHDVAFYC |
| G3646 | (1020) | HQAKYKGIRRRKWGKWVSEIRVPATRERLWLGSFSTAEGAAVAHDVAFYC |
| G3645 | (1021) | TQSKYKGIRRRKWGKWVSEIRVPGTRDRLWLGSFSTAEGAAVAHDVAFYC |
| G47 | (1022) | SQSKYKGIRRRKWGKWVSEIRVPGTRDRLWLGSFSTAEGAAVAHDVAFFC |
| G3643 | (1023) | TNNKLKGVRRRKWGKWVSEIRVPGTQERLWLGTYATPEAAAVAHDVAVYC |
| G3647 | (1024) | SQKTYKGVRCRRWGKWVSEIRVPGSRERLWLGTYSTPEGAAVAHDVASYC |
| G3648 | (1025) | SNKKFKGVRRRKWGKWVSEIRVPGTQERLWLGTYATPEAAAVAHDVAFYC |
| G3644 | (1026) | ERCRYRGVRRRRWGKWVSEIRVPGTRERLWLGSYATPEAAAVAHDTAVYF |
| G3649 | (1027) | EMMRYRGVRRRRWGKWVSEIRVPGTRERLWLGSYATAEAAAVAHDAAVCL |
| G3650 | (1028) | RRCRYRGVRRRAWGKWVSEIRVPGTRERLWLGSYAAPEAAAVAHDAAACL |
| G3651 | (1029) | ERCRYRGVRRRRWGKWVSEIRVPGTRERLWLGSYATPEAAAVAHDTAVYF |
| G3654 | (1030) | TTTKYRGVRLRKWGKWVSEIRLPNSRERIWLGSYDTPEEAARAFDAAFVC |
| G3652 | (1031) | KETRYKGVRLRQWGKWVAEIRLPNSRKRIWLGSYYTPEKAARAFDAAFIC |
| G3653 | (1032) | VERKYRGVRLRQWGKWVAEIRLPNSLKRIWLGSYDSPEKAARAFDAAFIC |
| G3655 | (1033) | ERRKYKGVRLRQWGKWAAEIRLPSSCERIWLGSYDTPEKAARAFDAAFIC |
| G2576 | (1034) | MQSKYKGVRKRKWGKWVSEIRLPNSRERIWLGSYDTPEKAARAFDAALYC |
| G872 | (1035) | MQSKYKGVRKRKWGKWVSEIRLPHSRERIWLGSYDTPEKAARAFDAAQFC |
| G1277 | (1036) | RERPFKGIRMRKWGKWVAEIREPNKRSRLWLGSYSTPEAAARAYDTAVFY |
| G12 | (1037) | RDKPYKGIRMRKWGKWVAEIREPNKRSRIWLGSYSTPEAAARAYDTAVFY |
| G24 | (1038) | DLKPYKGIRMRKWGKWVAEIREPNKRSRIWLGSYATPEAAARAYDTAVFY |
| G867 | (1039) | PSSKYKGVVPQPNGRWGAQIYEKHQRVWLGTFNEEDEAARAYDVAVHR-- |
| G40 | (1040) | RHPIYRGVRQRNSGKWVSEVREPNKKTRIWLGTFQTAEMAARAHDVAALA |
| G2294 | (1041) | RMKKYKGVRMRSWGSWVSEIRAPNQKTRIWLGSYSTAEAAARAYDAALLC |
| G2115 | (1042) | KIKKYKGVRMRSWGSWVSEIRAPNQKTRIWLGSYSTAEAAARAYDVALLC |

Fig. 3

Sequence
Name (SEQ ID NO.)

```
                        10        20        30
G431   (1043)  RKKGKLPKEARQQLLDWWSRHYKWPYPSE
G432   (1044)  KKKGKLPKEARQKLLTWWELHYKWPYPSE
G425   (1045)  RRAGKLPGDTTSVLKEWWRTHSKWPYPTE
G426   (1046)  RRAGKLPGDTTSVLKAWWQSHSKWPYPTE
G418   (1047)  RPQRGLPERSVNILRAWLFEHFLHPYPSD
G419   (1048)  RPQRGLPERAVTTLRAWLFEHFLHPYPSD
G412   (1049)  NGLFRKRKLTDEQVNMLEMSFGDEHKLES
G1545  (1050)  NGWFRKRKLSDEQVRMLEISFEDDHKLES
G399   (1051)  ETSRKKLRLSKDQSAFLEETFKEHNTLNP
G400   (1052)  DNSRKKLRLSKDQSAILEETFKDHSTLNP
G384   (1053)  NKKKRYHRHTQRQIQELESFFKECPHPDD
G388   (1054)  RKRKKYHRHTTDQIRHMEALFKETPHPDE
G392   (1055)  KYVRYTPEQVEALERLYNDCPK--PSSMR
G438   (1056)  KYVRYTAEQVEALERVYAECPK--PSSLR
G1585  (1057)  RWN-PKPEQIRILESIFNSGTINPP-REE
G1540  (1058)   WT-PTTEQIKILKELYYNNAIRSPTADQ
G415   (1059)  KSSSSACKQTDPKTQRLYISFQENQYPDK
G416   (1060)  GGRRRMFRLPRNAVEKLRQVFAETELPSK
G3002  (1061)  VQRRRKSKFTAEQREAMKDYAAKLGWTLKD
G3001  (1062)  VKRLKIKFTAEQTEKMRDYAEKLRWKVRP
G3000  (1063)  KKRVRIKINEEQKEKMKEFAERLGWRMQK
G2999  (1064)  KKRFRIKFNEEQKEKMMEFAEKIGWRMTK
G2998  (1065)  KKRFRIKFTTDQKERMMDFAEKLGWRMNK
G2997  (1066)  TKRFRIKFTAEQKEKMLAFAERLGWRIQK
G2996  (1067)  RKRHRIKFTAEQKERMLALAERIGWRIQR
G2995  (1068)  KKHKRIKFTAEQKVKMRGFAERAGWKING
G2994  (1069)   KRFRIKFTPEQKEKMLSFAEKVGWKIQR
G2993  (1070)  KKRFRIKFTQEQKEKMISFAERVGWKIQR
G2992  (1071)  RKRTRIKFTPEQKIKMRAFAEKAGWKING
G2991  (1072)  RKRFRIKFSQYQKEKMFEFSERVGWRMPK
G2990  (1073)  RKRFRIKFSQFQKEKMHEFAERVGWKMQK
G2989  (1074)  RKRFRIKFSSNQKEKMHEFADRIGWKIQK
```

Fig. 6A

Sequence
Name  (SEQ ID NO.)

```
                          40         50         60
G431   (1043)  QQ-----KLALAESTGLDQKQINNWFINQR
G432   (1044)  SE-----KVALAESTGLDQKQINNWFINQR
G425   (1045)  ED-----KAKLVQETGLQLKQINNWFINQR
G426   (1046)  ED-----KARLVQETGLQLKQINNWFINQR
G418   (1047)  AD-----KHLLARQTGLSRNQVSNWFINAR
G419   (1048)  VD-----KHILARQTGLSRSQVSNWFINAR
G412   (1049)  ER-----KDRLAAELGLDPRQVAVWFQNRR
G1545  (1050)  ER-----KDRLASELGLDPRQVAVWFQNRR
G399   (1051)  KQ-----KLALAKKLNLTARQVEVWFQNRR
G400   (1052)  KQ-----KQALAKQLGLRARQVEVWFQNRR
G384   (1053)  KQ-----RKELSRELSLEPLQVKFWFQNKR
G388   (1054)  KQ-----RQQLSKQLGLAPRQVKFWFQNRR
G392   (1055)  RQQ---LIRECPILSNIEPKQIKVWFQNRR
G438   (1056)  RQQ---LIRECSILANIEPKQIKVWFQNRR
G1585  (1057)  IQR---IRIRLQEYGQIGDANVFYWFQNRK
G1540  (1058)  IQK---ITARLRQFGKIEGKNVFYWFQNHK
G415   (1059)  AT-----KESLAKELQMTVKQVNNWFKHRR
G416   (1060)  AV-----RDRLAKELSLDPEKVNKWFKNTR
G3002  (1061)  KRALREEIRVEFCEGIGVTRYHFKTWVNNNK
G3001  (1062)  ER--QEEVEEFCVEIGVNRKNFRIWMNNHK
G3000  (1063)  KD--EEEIDKFCRMVNLRRQVFKVWMHNNK
G2999  (1064)  LE--DDEVNRFCREIKVKRQVFKVWMHNNK
G2998  (1065)  QD--EEELKRFCGEIGVKRQVFKVWMHNNK
G2997  (1066)  HD--DVAVEQFCAETGVRRQVLKIWMHNNK
G2996  (1067)  QD--DEVIQRFCQETGVPRQVLKVWLHNNK
G2995  (1068)  WD--EKWVREFCSEVGIERKVLKVWIHNNK
G2994  (1069)  QE--DCVVQRFCEEIGVKRRVLKVWMHNNK
G2993  (1070)  QE--ESVVQQLCQEIGIRRRVLKVWMHNNK
G2992  (1071)  CD--EKSVREFCNEVGIERGVLKVWMHNNK
G2991  (1072)  AD--DVVVKEFCREIGVDKSVFKVWMHNNK
G2990  (1073)  RD--EDDVRDFCRQIGVDKSVLKVWMHNNK
G2989  (1074)  RD--EDEVRDFCREIGVDKGVLKVWMHNNK
```

Fig. 6B

| Sequence Name | (SEQ ID NO.) | |
|---|---|---|
| G431 | (1043) | KRHWKPS |
| G432 | (1044) | KRHWKPS |
| G425 | (1045) | KRNWNSN |
| G426 | (1046) | KRNWHSN |
| G418 | (1047) | VRLWKPM |
| G419 | (1048) | VRLWKPM |
| G412 | (1049) | ARWKNKR |
| G1545 | (1050) | ARWKNKR |
| G399 | (1051) | ARTKLKQ |
| G400 | (1052) | ARTKLKQ |
| G384 | (1053) | TQMKAQH |
| G388 | (1054) | TQIKAIQ |
| G392 | (1055) | CREKQRK |
| G438 | (1056) | CRDKQRK |
| G1585 | (1057) | SRAKHKL |
| G1540 | (1058) | ARERQKK |
| G415 | (1059) | WSINSKP |
| G416 | (1060) | YMALRNR |
| G3002 | (1061) | KFYH |
| G3001 | (1062) | DKIIIDE |
| G3000 | (1063) | QAMKRNN |
| G2999 | (1064) | QAAKKKD |
| G2998 | (1065) | NNAKKPP |
| G2997 | (1066) | NSLGKKP |
| G2996 | (1067) | HTLGKSP |
| G2995 | (1068) | YFNNGRS |
| G2994 | (1069) | IHFSKKNN |
| G2993 | (1070) | QNLSKKS |
| G2992 | (1071) | YSLLNGK |
| G2991 | (1072) | ISGRSGA |
| G2990 | (1073) | NTFNRRD |
| G2989 | (1074) | NSFKFSG |

Fig. 6C

| Sequence Name (SEQ ID NO.) | 10 | 20 | 30 | 40 |
|---|---|---|---|---|
| G1752_At (668) | | | | |
| G1791_At (34) | | | | |
| G1795_At (36) | | | | |
| G30_At (18) | | | | |
| G3380_Os (70) | | | | |
| G3794_Zm (200) | | | | |
| G3736_Ta (162) | | | | |
| G3381_Os (72) | | | | |
| G3517_Zm (80) | | | | |
| G3739_Zm (166) | | | | |
| G3520_Gm (86) | | | | |
| G3383_Os (86) | | | | |
| G3737_Os (164) | | | | |
| G3515_Os (76) | | | | |
| G3516_Os (78) | | | | |
| G1792_At (8) | | | M E S S - - N R S S - | |
| G3518_Gm (82) | | | | |
| G3519_Gm (84) | | | | |
| G3735_Mt (160) | | | | |
| G26_At (1103) | | | M H S G K R P L S P E S M A G N R | |
| G22_At (1104) | | M S - - - - - S S D S V N N G V N S R M Y F R - | | |
| G1006_At (1105) | | M Y G Q C N I E S D Y A L L E S I T R H L L G G | | |
| G28_At (1106) | | M S M T A D S Q S D Y A F L E S I R R H L L G - | | |
| G1751_At (1107) | M H Y P N N R T E F V G A P A P T R Y Q K E Q L S P E Q E L S V I V S A | | | |
| G45_At (1108) | V R V C V Y T Q K T P D F M W N L K P S M K C G Q Y L R T Q V S P T V L P N Y | | | |
| G1266_At (532) | | | | |
| G2512_At (560) | | | | |

Fig. 9A

| Sequence Name (SEQ ID NO.) | 50 | 60 | 70 | 80 |
|---|---|---|---|---|
| G1752_At (668) | | | | |
| G1791_At (34) | | | | |
| G1795_At (36) | | | | |
| G30_At (18) | | | | |
| G3380_Os (70) | | | | |
| G3794_Zm (200) | | | | |
| G3736_Ta (162) | | | | |
| G3381_Os (72) | | | | |
| G3517_Zm (80) | | | | |
| G3739_Zm (166) | | | | |
| G3520_Gm (86) | | | | |
| G3383_Os (86) | | | | |
| G3737_Os (164) | | | | |
| G3515_Os (76) | | | | |
| G3516_Os (78) | | | | |
| G1792_At (8) | - - - - - - - - - - - - N N Q - - - - - - - - - - - - - - - - - - - - - | | | |
| G3518_Gm (82) | | | | |
| G3519_Gm (84) | | | | |
| G3735_Mt (160) | | | | |
| G26_At (1103) | E E K K E L C C C S T L S E S D - - - - - - - - - - - - - - - - | | | |
| G22_At (1104) | - - - - - - - - N P S F S N V - - - - - - - - - - - - - - - - - - | | | |
| G1006_At (1105) | G G E N E L R L N E S T P S S - - - - - - - - - - - - - - - - - | | | |
| G28_At (1106) | - - E S E P I L S E S T A S S V T Q S C V T G Q S I K P V Y G R N P S F S K L - | | | |
| G1751_At (1107) | L Q H V I S G E N E T A P C Q G F S S D S T V I S A G M P R L D S D T C Q V C R | | | |
| G45_At (1108) | P A A D S T M A F G N I Q E L D G E I L K N V W A N Y I G T P Q T D T R S I Q - | | | |
| G1266_At (532) | | | | |
| G2512_At (560) | | | | |

Fig. 9B

| Sequence Name (SEQ ID NO.) | 90 | 100 | 110 | 120 |
|---|---|---|---|---|
| G1752_At (668) | | ME YS - - Q S S M Y S | - - - S P - - | - - - S |
| G1791_At (34) | | ME R I - - - - - - - - | - - - - - - - - | - - - - - |
| G1795_At (36) | | MD Q G - - - - - - - - | - - - - - - - - | - - - - - |
| G30_At (18) | | MD Q G - - - - - - - - | - - - - - - - - | - - - - - |
| G3380_Os (70) | | MD G - - - - - - - - - | - - - - - - - - | - - - - - |
| G3794_Zm (200) | | MD - - - - - - - - - - | - - - - - - - - | - - - - - |
| G3736_Ta (162) | | ME G G - - - - - - - - | - - - - - - - - | - - - - - |
| G3381_Os (72) | | MD H H - - - - - - - - | - - - - - - - - | - - - - - |
| G3517_Zm (80) | | MD G - - - - - - - - - | - - - - - - - - | - - - - - |
| G3739_Zm (166) | | MD G - - - - - - - - - | - - - - - - - - | - - - - - |
| G3520_Gm (86) | | ME E E - - - - - - - - | - - - - - - - - | - - - - - |
| G3383_Os (86) | | ME D - - - - - - - - - | - - - - - - - - | - - - - - |
| G3737_Os (164) | | ME D - - - - - - - - - | - - - - - - - - | - - - - - |
| G3515_Os (76) | | ME D - - - - - - - - - | - - - - - - - - | - - - - - |
| G3516_Os (78) | | ME D - - - - - - - - - | - - - - - - - - | - - - - - |
| G1792_At (8) | - - - - - - - - - - - - - - - S | Q D D - - - - - - - - | - - - - - - - - | - - - - - |
| G3518_Gm (82) | | ME G - - - - - - - - - | - - - - - - - - | - - - - - |
| G3519_Gm (84) | | ME G - - - - - - - - - | - - - - - - - - | - - - - - |
| G3735_Mt (160) | | ME G - - - - - - - - - | - - - - - - - - | - - - - - |
| G26_At (1103) | - V S D F V S E L T G Q P I P S S I | D D Q - - - - - - - - | - - - - - - - - | - - - - - |
| G22_At (1104) | - - - I L N D N W S D L P - - L S V | D D S - - - - - - - - | - - - - - - - - | Q D M A I Y |
| G1006_At (1105) | - - - C F T E S W G G L P - - L K E N | D S - - - - - - - - - | - - - - - - - - | E D M L V Y |
| G28_At (1106) | - Y P C F T E S W G D L P - - L K E N | D S - - - - - - - - - | - - - - - - - - | E D M L V Y |
| G1751_At (1107) | I E G C L G C N Y F F A P N - Q R I | E K N H Q - - - - - - | - - - - - - - - | - - - - Q |
| G45_At (1108) | - V P E V S R T W E A L P T L D D I | P E G - - - - - - - - | - - - - - - - - | - - - - - |
| G1266_At (532) | | MD P F L I Q S P F S G | - - F S P E Y S | I G S |
| G2512_At (560) | | ME Y - - - Q T N F L S G | E F S P E N S | S S S |

Fig. 9C

| Sequence Name (SEQ ID NO.) | 130 | 140 | 150 | 160 |
|---|---|---|---|---|
| G1752_At(668) | SWSSSQESLLWNESC- | FLDQSSEPQAFFC-- | PNYDYSDDF | |
| G1791_At(34) | ES------YNTNEM- | --------------- | --------- | |
| G1795_At(36) | GR-----GVGAEHG- | --------------- | --------- | |
| G30_At(18) | GRSSGS-GGGGAEQG | --------------- | --------- | |
| G3380_Os(70) | DGGGGWDDQGNGGG- | --------------- | --------- | |
| G3794_Zm(200) | DGG------------ | --------------- | --------- | |
| G3736_Ta(162) | EGS------GGGG-- | --------------- | --------- | |
| G3381_Os(72) | HQQQ-----QQEG-- | --------------- | --------- | |
| G3517_Zm(80) | EWSK--D---GGGG- | --------------- | --------- | |
| G3739_Zm(166) | DWSK--D---GGGG- | --------------- | --------- | |
| G3520_Gm(86) | SKEK------KKDT- | --------------- | --------- | |
| G3383_Os(86) | NRS-------KDT-- | --------------- | --------- | |
| G3737_Os(164) | DK--------KEA-- | --------------- | --------- | |
| G3515_Os(76) | DKS-------KEG-- | --------------- | --------- | |
| G3516_Os(78) | DK--------KEG-- | --------------- | --------- | |
| G1792_At(8) | --------------- | --------------- | --------- | |
| G3518_Gm(82) | GRSSVS----NGN-- | --------------- | --------- | |
| G3519_Gm(84) | GRSSVS----NGN-- | --------------- | --------- | |
| G3735_Mt(160) | DHKLVSNS--TNGNG | --------------- | --------- | |
| G26_At(1103) | SSS----LTLQEKS- | --------------- | --------- | |
| G22_At(1104) | NTLRDAVSSGWTPSVP | ----PVT---- | SPAEENKPPATKA | |
| G1006_At(1105) | GLLKDAFH--FDTSSS | ----DLSCLFDFPAVKVEPTENFT | | |
| G28_At(1106) | GILNDAFHGGWEPSSSSSDEDRS | ---SFPSVKIETPESFA | | |
| G1751_At(1107) | EEEITSSSNRRRESSP | --------------- | -------VA | |
| G45_At(1108) | SREMLQSLDMSTEDQEWTEILDAIASFPN | --KTNHDPLTN | | |
| G1266_At(532) | SPDSFSSSSSNNYSLPFNENDSE | -EMFLYGLIEQSTQQTY | | |
| G2512_At(560) | SWSS-QESFLWEES-- | FLHQSFD-QSFLLSSPTDNYCDDF | | |

Fig. 9D

| Sequence Name (SEQ ID NO.) | 170 | 180 | 190 | 200 |
|---|---|---|---|---|
| G1752_At(668) | F S F E S P E M M I K | E E I Q N G D V S N S E E E E K V G I D E E R S | | Y R G V R |
| G1791_At(34) | - - - - - - - - - - - | - - - - - - - - - - - - - - - - - - - - - - - - K | | Y R G V R |
| G1795_At(36) | - - - - - - - - - - - | - - - - - - - - - - - - - - - - - - - - - - - - K | | Y R G V R |
| G30_At(18) | - - - - - - - - - - - | - - - - - - - - - - - - - - - - - - - - - - - - K | | Y R G V R |
| G3380_Os(70) | - - - E - T - - - T K | - - - - - - - - - - - - - - - - - - - - - - - - | | Y R G V R |
| G3794_Zm(200) | - - - E - P - - - T K | - - - - - - - - - - - - - - - - - - - - - - - - | | Y R G V R |
| G3736_Ta(162) | - - - E - P - - - T K | - - - - - - - - - - - - - - - - - - - - - - - - | | Y R G V R |
| G3381_Os(72) | - - - E L V - - - A K | - - - - - - - - - - - - - - - - - - - - - - - - | | Y R G V R |
| G3517_Zm(80) | - - - E - P - - - T K | - - - - - - - - - - - - - - - - - - - - - - - - | | Y R G V R |
| G3739_Zm(166) | - - - E - P - - - T K | - - - - - - - - - - - - - - - - - - - - - - - - | | Y R G V R |
| G3520_Gm(86) | - - - K E E - - - P R | - - - - - - - - - - - - - - - - - - - - - - - - | | Y R G V R |
| G3383_Os(86) | - - - A T - - - - - K | - - - - - - - - - - - - - - - - - - - - - - - - | | Y R G V R |
| G3737_Os(164) | - - - A S - - - - - K | - - - - - - - - - - - - - - - - - - - - - - - - | | Y R G V R |
| G3515_Os(76) | - - - K S S - - - S S | - - - - - - - - - - - - - - - - - - - - - - - - | | Y R G V R |
| G3516_Os(78) | - - - K - - - - - - - | - - - - - - - - - - - - - - - - - - - - - - - - | | Y R G V R |
| G1792_At(8) | - - - - - - - - - K Q | - - - - - - - - - - - - - - - - - - - - - - - A R | | F R G V R |
| G3518_Gm(82) | - - - - - - - - - - - | - - - - - - - - - - - - - - - - - - - - - - V E V R | | Y R G I R |
| G3519_Gm(84) | - - - - - - - - - - - | - - - - - - - - - - - - - - - - - - - - - - C E V R | | Y R G I R |
| G3735_Mt(160) | - - - N G N G - - N S | - - - - - - - - - - - - - - - - - - - - - - D Q I K | | Y R G I R |
| G26_At(1103) | - - - N S R - - - Q R | - - - - - - - - - - - - - - - - - - - - - - - - N | | Y R G V R |
| G22_At(1104) | S G S H A P - - - R Q | - - - - - - K - - - - - - - - - - - - - - G M Q | | Y R G V R |
| G1006_At(1105) | A M E E K P - - - K K | - - A I P V T - - - - - - - - - E T A V K A K H | | Y R G V R |
| G28_At(1106) | A V D S V P V - - K K | E K T S P V S A A - - - - - - V T A A K G K H | | Y R G V R |
| G1751_At(1107) | K K A E G G G K I R K | R K N K - - - - - - - - - - - - - - - - K N G | | Y R G V R |
| G45_At(1108) | P T I D S C S L S S R | V S C K - - - - - - - - - - - - - - - T R K | | Y R G V R |
| G1266_At(532) | I D S D S Q D L P I K | - - - - - - S V S - S R K S - - - - - - - E K S | | Y R G V R |
| G2512_At(560) | F A F E S S - - I I K | E E G K E A T V A - A E E E - - - - - - - E K S | | Y R G V R |
| (1109) | K | | | Y R G V R |

Fig. 9E

| Sequence Name (SEQ ID NO.) | 210 | 220 | 230 | 240 |
|---|---|---|---|---|
| G1752_At (668)  | K R P W G K F A A E I R D | S T R N G I R V W L G T F D | K A E E A A L | A Y D Q A A |
| G1791_At (34)   | K R P W G K Y A A E I R D | S A R H G A R V W L G T F N | T A E D A A R | A Y D R A A |
| G1795_At (36)   | R R P W G K Y A A E I R D | S R K H G E R V W L G T F D | T A E E A A R | A Y D Q A A |
| G30_At (18)     | R R P W G K Y A A E I R D | S R K H G E R V W L G T F D | T A E D A A R | A Y D R A A |
| G3380_Os (70)   | R R P S G K F A A E I R D | S S R Q S V R V W L G T F D | T A E E A A R | A Y D R A A |
| G3794_Zm (200)  | R R P S G K F A A E I R D | S S R Q S V R M W L G T F D | T A E E A A R | A Y D R A A |
| G3736_Ta (162)  | R R P W G K F A A E I R D | S S R H G V R M W L G T F D | T A E E A A A | A Y D R S A |
| G3381_Os (72)   | R R P W G K F A A E I R D | S S R H G V R V W L G T F D | T A E E A A R | A Y D R S A |
| G3517_Zm (80)   | R R P W G K Y A A E I R D | S S R H G V R I W L G T F D | T A E E A A R | A Y D R S A |
| G3739_Zm (166)  | R R P W G K Y A A E I R D | S S R H G V R I W L G T F D | T A E E A A R | A Y D R S A |
| G3520_Gm (86)   | R R P W G K F A A E I R D | P A R H G A R V W L G T F L | T A E E A A R | A Y D R A A |
| G3383_Os (86)   | R R P W G K F A A E I R D | P E R G G A R V W L G T F D | T A E E A A R | A Y D R A A |
| G3737_Os (164)  | R R P W G K F A A E I R D | P E R G G S R V W L G T F D | T A E E A A R | A Y D R A A |
| G3515_Os (76)   | K R P W G K F A A E I R D | P E R G G A R V W L G T F D | T A E E A A R | A Y D R A A |
| G3516_Os (78)   | K R P W G K F A A E I R D | P E R G G S R V W L G T F D | T A E E A A R | A Y D R A A |
| G1792_At (8)    | R R P W G K F A A E I R D | P S R N G A R L W L G T F E | T A E E A A R | A Y D R A A |
| G3518_Gm (82)   | R R P W G K F A A E I R D | P T R K G T R I W L G T F D | T A E Q A A R | A Y D A A A |
| G3519_Gm (84)   | R R P W G K F A A E I R D | P T R K G T R I W L G T F D | T A E Q A A R | A Y D A A A |
| G3735_Mt (160)  | R R P W G K F A A E I R D | P T R K G T R I W L G T F D | T A E Q A A R | A Y D A A A |
| G26_At (1103)   | Q R P W G K W A A E I R D | P N K - A A R V W L G T F D | T A E E A A L | A Y D K A A |
| G22_At (1104)   | R R P W G K F A A E I R D | P K K N G A R V W L G T Y E | T P E D A A V | A Y D R A A |
| G1006_At (1105) | Q R P W G K F A A E I R D | P A K N G A R V W L G T F E | T A E D A A L | A Y D I A A |
| G28_At (1106)   | Q R P W G K F A A E I R D | P A K N G A R V W L G T F E | T A E D A A L | A Y D R A A |
| G1751_At (1107) | Q R P W G K F A A E I R D | P K R - A T R V W L G T F E | T A E D A A R | A Y D R A A |
| G45_At (1108)   | K R P W G K F A A E I R D | S T R N G V R V W L G T F Q | T A E E A A M | A Y D K A A |
| G1266_At (532)  | R R P W G K F A A E I R D | S T R N G I R V W L G T F E | S A E E A A L | A Y D Q A A |
| G2512_At (560)  | K R P W G K F A A E I R D | S T R K G I R V W L G T F D | T A E A A A L | A Y D Q A A |
| (1109)          | R R P W G K F A A E I R D | P . R    G . R V W L G T F D | T A E E A A R | A Y D R A A |

Fig. 9F

| Sequence Name (SEQ ID NO.) | 250 | 260 | 270 | 280 |
|---|---|---|---|---|
| G1752_At (668) | F A T K G - S L A T L N F P V E | V V R E S L K K M E N V N L H D G G S P V M A L | | |
| G1791_At (34) | F G M R G - Q R A I L N F P H E | Y Q M M K D - - - - - - - - - - - - - G - - - - - | | |
| G1795_At (36) | Y S M R G - Q A A I L N F P H E | Y N M G S G - - - - - - - - - - - - - V - - - - - | | |
| G30_At (18) | Y S M R G - K A A I L N F P H E | Y N M G T - - - - - - - - - - - - - - - - - - - - | | |
| G3380_Os (70) | Y A M R G - H L A V L N F P A E | - - - - - - - - - - - - - - - - - - A - - - - - | | |
| G3794_Zm (200) | Y A M R G - Q I A V L N F P A E | - - - - - - - - - - - - - - - - - - A - - - - - | | |
| G3736_Ta (162) | Y S M R G - R N A V L N F P D R | - - - - - - - - - - - - - - - - - - A - - - - - | | |
| G3381_Os (72) | Y S M R G - A N A V L N F P A D | - - - - - - - - - - - - - - - - - - A - - - - - | | |
| G3517_Zm (80) | N S M R G - A N A V L N F P E D | - - - - - - - - - - - - - - - - - - A - - - - - | | |
| G3739_Zm (166) | Y S M R G - A N A V L N F P E D | - - - - - - - - - - - - - - - - - - A - - - - - | | |
| G3520_Gm (86) | Y E M R G - A L A V L N F P N E | - - - - - - - - - - - - - - - - - - Y - - - - - | | |
| G3383_Os (86) | Y A Q R G - A A A V L N F P | - - - - - - - - - - - - - - - - - - A - - - - - | | |
| G3737_Os (164) | F A M K G - A M A V L N F P | - - - - - - - - - - - - - - - - - - - - - - - - | | |
| G3515_Os (76) | F A M K G - A T A M L N F P | - - - - - - - - - - - - - - - - - - G - - - - - | | |
| G3516_Os (78) | F A M K G - A T A V L N F P A S | - - - - - - - - - - - - - - - - - - G - - - - - | | |
| G1792_At (8) | F N L R G - H L A I L N F P N E | Y Y P - - - - - - - - - - - - - - - - - - - - - | | |
| G3518_Gm (82) | F H F R G - H R A I L N F P N E | Y Q S H N P - - - - - - - - - - - - N - - - - - | | |
| G3519_Gm (84) | F H F R G - H R A I L N F P N E | Y Q S H N P - - - - - - - - - - - - N - - - - - | | |
| G3735_Mt (160) | F H F R G - H R A I L N F P N E | Y Q A P N S - - - - - - - - - - - - S - - - - - | | |
| G26_At (1103) | F E F R G - H K A K L N F P E H | I R V N P T - - - - - - - - - - - - - - - - - - | | |
| G22_At (1104) | F Q L R G - S K A K L N F P H L | I G S C - - - - - - - - - - - - - - - - - - - - | | |
| G1006_At (1105) | F R M R G - S R A L L N F P L R | V N S G - - - - - - - - - - - - - - - - - - - - | | |
| G28_At (1106) | F R M R G - S R A L L N F P L R | V N S G - - - - - - - - - - - - - - - - - - - - | | |
| G1751_At (1107) | I G F R G - P R A K L N F P F V | D Y T S S - - - - - - - - - - - - - - - - - - - | | |
| G45_At (1108) | V R I R G T Q K A H T N F Q L E | T V I K A M E M - - - - - - - D C N - - - - - | | |
| G1266_At (532) | F S M R G - S S A I L N F S A E | R V Q E S L S E I K - Y T Y E D G C S P V V A L | | |
| G2512_At (560) | F A L K G - S L A V L N F P A D | V V E E S L R K M E N V N L N D G E S P V I A L | | |
| (1109) | F   M R G       A . L N F P   . | | | |

Fig. 9G

| Sequence Name (SEQ ID NO.) | 290 | 300 | 310 | 320 |
|---|---|---|---|---|
| G1752_At (668) | K R K H S L R N R P R - - - - - G K K R | S S S S S | - - S S S - S | N S S S C S S S |
| G1791_At (34) | P N - - - - - G S H E - - - - - N A V A | S S S S G | - - - - - - - Y | R G G G G G D |
| G1795_At (36) | S S S T A M A G S S S - - - - - A S A S A | S S S - - - | - - - - - - - - | - - - - - - - |
| G30_At (18) | - - - - - - - G S S S - - - - - T A A N | S S S S - - | - - - - - - - - | - - - - - - - |
| G3380_Os (70) | R N Y V R G S - - - - - - - - - G S - - - | S S S S - - | - - - - - R Q - | - - - H Q |
| G3794_Zm (200) | R N Y V R G - - - - - - - - - - G S - - - | S S S - - - | - - - - - R Q - | - - - Q Q |
| G3736_Ta (162) | H V Y E A E A R R - Q - - - - - G Q - G | S S S S A - | - - - - - R Q Q | N Q Q Q Q |
| G3381_Os (72) | H I Y A R Q L H N - N - - - - - N A A A G | S S S - - - | - - - - - S S - | - - - A A |
| G3517_Zm (80) | P A Y A A A A S R - - - - - - - G S - A G G | S S - - - - | - - - - - R P - | - - - - - - |
| G3739_Zm (166) | H A Y A A A C - R - - - - - - - G S G S | S S S S - - | - - - - - R H R | - Q Q Q Q |
| G3520_Gm (86) | P S C S S M N S S - - - - - - - S T L A P | S S S - - - | - - - - - S N S | M L K S D |
| G3383_Os (86) | A A A A G R G G G - - - - - - - A G G A A | S G S - - - | - - - - - - S S | S S S A Q |
| G3737_Os (164) | - - - - G R T S S - - - - - - - - T G S S | S S S S - - | - - - - - T P P | A P V T |
| G3515_Os (76) | D H H H G A A S R - M - - - - - T S T G | S S S S - - | - - - - - F T T | P P P A N |
| G3516_Os (78) | G S S A G A A P G G R - - - - - T S G G | S S S - - - | - - - - - T T S | A P A S |
| G1792_At (8) | R M D D Y S L R P P Y - - - - - A S S S | S S S S - - | - - - - - G S T | S T N V S |
| G3518_Gm (82) | S S L P M P L A V S A - - - - - - P P S Y | S S S - - - | - - - - - S T S | N Y S G D |
| G3519_Gm (84) | S S L P M P L I V P - - - - - - - P P S Y | S S S - - - | - - - - - F T S | N Y S A D |
| G3735_Mt (160) | S S L P M P L T M P P P P S S N P P P S | S S S S - - | - - - - - S F S | S Y T V D |
| G26_At (1103) | Q L Y P S P A T S H D R - I I V T P P S P P P P I | A P D I L L D Q Y G H F Q S R |
| G22_At (1104) | K Y E P V R I R P R R - - - - - R S P E P | S V S - - - | - - - - - D Q L | T S E Q K |
| G1006_At (1105) | E P D P V R I T S K R - - - - - S S S S | S S S S S S | S T S S - S E N | G K L K R R |
| G28_At (1106) | E P D P V R I K S K R - - - - - S S F S | S S N - - - | - - - - - - E N | G A P K K R |
| G1751_At (1107) | V S S P V A A D D I G - - - - - A K A S A | S A S V S - | - - - - - A T D | S V E A E |
| G45_At (1108) | P N Y Y R M N N S N T - - - - - S D P L R | S S R - - K | I G L R - G K E | A V K A Y |
| G1266_At (532) | K R K H S M R R R - M - - - - - T N K K | T K D S D - | - - - - - - - - | F D H R |
| G2512_At (560) | K R K H S M R N R P R - - - - - G K K K | S S S S S T | L T S S P S S S | S S Y S S S |

Fig. 9H

| Sequence Name (SEQ ID NO.) | 330 | 340 | 350 | 360 |
|---|---|---|---|---|
| G1752_At (668) | S S T S S | | | |
| G1791_At (34) | D | | | |
| G1795_At (36) | | | | |
| G30_At (18) | | | | |
| G3380_Os (70) | Q | | | |
| G3794_Zm (200) | Q G G G G | | | |
| G3736_Ta (162) | Q G Q | | | |
| G3381_Os (72) | A A | | | |
| G3517_Zm (80) | A G | | | |
| G3739_Zm (166) | Q G | | | |
| G3520_Gm (86) | H | | | |
| G3383_Os (86) | R | | | |
| G3737_Os (164) | T | | | |
| G3515_Os (76) | S S A A | | | |
| G3516_Os (78) | R | | | |
| G1792_At (8) | R | | | |
| G3518_Gm (82) | D N N N H | | | |
| G3519_Gm (84) | D N N - H | | | |
| G3735_Mt (160) | D | | | |
| G26_At (1103) | S S D | | | |
| G22_At (1104) | R E S | | | |
| G1006_At (1105) | R | | | |
| G28_At (1106) | R T V | | | |
| G1751_At (1107) | Q W N | | | |
| G45_At (1108) | D E V V D G M V E N H C A L S Y C S T K E H S E T R G L R G S E E T W F D L R K | | | |
| G1266_At (532) | S | | | |
| G2512_At (560) | S S S S S | | | |

Fig. 9I

| Sequence Name (SEQ ID NO.) | 370 | 380 | 390 | 400 |
|---|---|---|---|---|
| G1752_At(668)   | - - - - - - T - - - - | S R S S S K Q S V V K - Q E S G - T | L V V F E D L G A E |
| G1791_At(34)    | - - - - - - - - - - - - - - - - - | G R E - - - - - - - - - - - | V I E F E Y L D D S |
| G1795_At(36)    | - - - - - - - - - - - - - - - - - | S R Q - - - - - - - - - - - | V F E F E Y L D D S |
| G30_At(18)      | - - - - - - - - - - - - - - - - - | S Q Q - - - - - - - - - - - | V F E F E Y L D D S |
| G3380_Os(70)    | - - - - - - - - - - - - - - - - - | R Q - - - - - - - - - - - | V I E L E C L D D Q |
| G3794_Zm(200)   | - - - - G G G S - - - - | G G G A G Q Q - - - - - - - - - - - | V I E L E C L D D Q |
| G3736_Ta(162)   | - - - - - - - - - - - - - - - - - | S G - - - - - - - - - - - - - | V I E F E Y L D D D |
| G3381_Os(72)    | - - - - - - - - - - - - - - - - - | A A R P P - - - - - - - - - | P I E F E Y L D D H |
| G3517_Zm(80)    | - - - - - - - - - - - - - - - - - | S G R D - - - - - - - - - - | V I E F E Y L D D E |
| G3739_Zm(166)   | - - - - - - - - - - - - - - - - - | S G R D - - - - - - - - - - | V I E L E Y L D D E |
| G3520_Gm(86)    | - - - - - - - - - - - - - - - - - | G K Q - - - - - - - - - - - | V I E F E C L D D K |
| G3383_Os(86)    | - - - - - - - - - - - - - - - - - | G R G - - - D - - - - - - - | K I E F E Y L D D K |
| G3737_Os(164)   | - - - - - - - - - - - - - - - - - | S R H C A - D - - - - T T E K | V E L V Y L D D K |
| G3515_Os(76)    | - - - - - - - - - - - - - - - - - | A G R G G S - D - - - R T T D K | V E L E C L D D K |
| G3516_Os(78)    | - - - - - - - - - - - - - - - - - | G R A R V P D - - - - S E K | V E L E C L D D R |
| G1792_At(8)     | - - - - - - - - - - - - - - - - - | Q N Q - - - - - - - - - R E | V F E F E Y L D D K |
| G3518_Gm(82)    | - - - L V R P A F S G E I M Q | G G D H - - - - - - - D D D T F | E L E Y F D N K |
| G3519_Gm(84)    | - - - L V R P - - - G E I M Q | G G D - - - - - - - - L D D T F | E L E Y L D N K |
| G3735_Mt(160)   | - - - - - - - - - - - - - - - - - | G F D - - - - - - - - - - - - | E L E F L D N K |
| G26_At(1103)    | - - - - - - - - - - - - - - - - - | S S A N L S M N - - - - - M L S S S S S | L N H Q |
| G22_At(1104)    | - - - - - - - - - - - - - - - - - | H V D D G E S S - - - - - - L V V P E | L D F T V D Q F Y |
| G1006_At(1105)  | - - - - - - - - - - - - - - - - - | K A E N L T S E - - - - - - V V Q V K C | E V - G D E T R |
| G28_At(1106)    | - - - - - - - - - - - - - - - - - | A A G G G M D K - - - - - - - - G L T | V K C E - V E V A |
| G1751_At(1107)  | - - - - - - - - - - - - - - - - - | G G G G D - - - - - - - - - - - | C N M E E W M N M M |
| G45_At(1108)    | R R R S N E D S M C Q E V E M Q K T V T G E E T V C D V F G | L F E F E D L G S D |
| G1266_At(532)   | - - - - - - - - - - - - - - - - - | - - - - - - - V K - - L D N - - | V V V F E D L G E Q |
| G2512_At(560)   | - - - - - - - L - - - - | S S R S R K Q S V V M T Q E S N T T | L V V L E D L G A E |

Fig. 9J

| Sequence Name (SEQ ID NO.) | 410 | 420 | 430 | 440 |
|---|---|---|---|---|
| G1752_At (668) | Y L E Q L L | M S S C | | |
| G1791_At (34) | L L E E L L | D Y G E - R S N Q - D N C N D A N R | | |
| G1795_At (36) | V L E E L L | E E - - - - - - - - - - - - - G - E - - - - - - - - - - - K P N K - - | | |
| G30_At (18) | V L D E L L | E Y - G - E - - - - - - - - - - - N Y N K T H N I N M G K R Q | | |
| G3380_Os (70) | V L Q E M L | K G G D D Q Y R S A A G S K R N N Y | | |
| G3794_Zm (200) | V L Q E M L | K G G D - - - - - - - G K K | | |
| G3736_Ta (162) | V L Q S M L | H D H D K S - - - - - - N K | | |
| G3381_Os (72) | V L Q E M L | R D H T T - - - - - - - N K | | |
| G3517_Zm (80) | V L Q E M L | R S Q E P S A - - A A A Q K K K | | |
| G3739_Zm (166) | V L Q E M L | R N H E P S S - - S - A R K K M | | |
| G3520_Gm (86) | L L E D L L | D C D D Y A Y - - - - - E K D L P K N | | |
| G3383_Os (86) | V L D D L L | D D E - K Y R G - - - - - K | | |
| G3737_Os (164) | V L D E L L | A E D Y S Y R N - - - - N N N Y | | |
| G3515_Os (76) | V L E D L L | A E T - N Y R D - - - - - K N Y | | |
| G3516_Os (78) | V L E E L L | A E D - K Y N - - - - - - K N | | |
| G1792_At (8) | V L E E L L | D S - - E E R K R | | |
| G3518_Gm (82) | L L E E L L | Q M Q D N R H F | | |
| G3519_Gm (84) | L L E E L L | Q M Q D N R H F | | |
| G3735_Mt (160) | L L Q E L L | - - Q D G T Q | | |
| G26_At (1103) | G L R P N L | E D G E - - - N V K N I S I H K R R K | | |
| G22_At (1104) | F D G S L L | M D - - - Q S E C S Y S D N R I | | |
| G1006_At (1105) | V D - E L L | V S | | |
| G28_At (1106) | R G - R L L | V L | | |
| G1751_At (1107) | M M M D F G | N G D S - - - S D S G N T I A D M F Q | | |
| G45_At (1108) | Y L E T L L | S S F | | |
| G1266_At (532) | Y L E E L L | G S S E - - - N S G T W | | |
| G2512_At (560) | Y L E E L - | M R S C - - - S | | |
| | V L . E L L | | | |

Fig. 9K

| Sequence Name (SEQ ID NO.) | 450 | 460 | 470 | 480 |
|---|---|---|---|---|
| G1752_At (668) | | | | |
| G1791_At (34) | | | | |
| G1795_At (36) | - - - - G K K K | | | |
| G30_At (18) | | | | |
| G3380_Os (70) | | | | |
| G3794_Zm (200) | | | | |
| G3736_Ta (162) | | | | |
| G3381_Os (72) | | | | |
| G3517_Zm (80) | | | | |
| G3739_Zm (166) | | | | |
| G3520_Gm (86) | | | | |
| G3383_Os (86) | | | | |
| G3737_Os (164) | | | | |
| G3515_Os (76) | | | | |
| G3516_Os (78) | | | | |
| G1792_At (8) | | | | |
| G3518_Gm (82) | | | | |
| G3519_Gm (84) | | | | |
| G3735_Mt (160) | | | | |
| G26_At (1103) | | | | |
| G22_At (1104) | | | | |
| G1006_At (1105) | | | | |
| G28_At (1106) | | | | |
| G1751_At (1107) | | | | |
| G45_At (1108) | | | | |
| G1266_At (532) | | | | |
| G2512_At (560) | | | | |

Fig. 9L

Sequence
Name (SEQ ID NO.)

| Name (SEQ ID NO.) | | | | | | | | | | | | | | |
|---|---|---|---|---|---|---|---|---|---|---|---|---|---|---|
| G1752_At (1075) | L | V | V | F | E | D | L | G | A | E | Y | L | E | Q | L | L |
| G1791_At (1076) | V | I | E | F | E | Y | L | D | D | S | L | L | E | E | L | L |
| G1795_At (1077) | V | F | E | F | E | Y | L | D | D | S | V | L | E | E | L | L |
| G30_At (1078) | V | F | E | F | E | Y | L | D | D | S | V | L | D | E | L | L |
| G3380_Os (1079) | V | I | E | L | E | C | L | D | D | Q | V | L | Q | E | M | L |
| G3794_Zm (1080) | V | I | E | L | E | C | L | D | D | Q | V | L | Q | E | M | L |
| G3736_Ta (1081) | V | I | E | F | E | Y | L | D | D | D | V | L | Q | S | M | L |
| G3381_Os (1082) | P | I | E | F | E | Y | L | D | D | H | V | L | Q | E | M | L |
| G3517_Zm (1083) | V | I | E | F | E | Y | L | D | D | E | V | L | Q | E | M | L |
| G3739_Zm (1084) | V | I | E | L | E | Y | L | D | D | E | V | L | Q | E | M | L |
| G3520_Gm (1085) | V | I | E | F | E | C | L | D | D | K | L | L | E | D | L | L |
| G3383_Os (1086) | K | I | E | F | E | Y | L | D | D | K | V | L | D | D | L | L |
| G3737_Os (1087) | K | V | E | L | V | Y | L | D | D | K | V | L | D | E | L | L |
| G3515_Os (1088) | K | V | E | L | E | C | L | D | D | K | V | L | E | D | L | L |
| G3516_Zm (1089) | K | V | E | L | E | C | L | D | D | R | V | L | E | E | L | L |
| G1792_At (1090) | V | F | E | F | E | Y | L | D | D | K | V | L | E | E | L | L |
| G3518_Gm (1091) | T | F | E | L | E | Y | F | D | N | K | L | L | E | E | L | L |
| G3519_Gm (1092) | T | F | E | L | E | Y | L | D | N | K | L | L | E | E | L | L |
| G3735_Mt (1093) | - | - | E | L | E | F | L | D | N | K | L | L | Q | E | L | L |
| G26_At (1094) | S | S | S | S | S | S | L | N | H | Q | G | L | R | P | N | L |
| G22_At (1095) | E | L | D | F | T | V | D | Q | F | Y | F | D | G | S | L | L |
| G1006_At (1096) | K | C | E | V | - | G | D | E | T | R | V | D | - | E | L | L |
| G28_At (1097) | T | V | K | C | E | - | V | E | V | A | R | G | - | R | L | L |
| G1751_At (1098) | C | N | M | E | E | W | M | N | M | M | M | M | M | D | F | G |
| G45_At (1099) | L | F | E | F | E | D | L | G | S | D | Y | L | E | T | L | L |
| G1266_At (1100) | V | V | V | F | E | D | L | G | E | Q | Y | L | E | E | L | L |
| G2512_At (1101) | L | V | V | L | E | D | L | G | A | E | Y | L | E | E | L | - |
| (1102) | | | | | E | | D | | | | | L | | | L | |

Fig. 10

Sequence
Name (SEQ ID NO.)

```
G3752  (1110) -RRGQATDPHSIAERLRREKISERMKNLQVLVPNSNKAD--KASMLDEIIDYVKFLQLQVK-
G3753  (1111) -RRGQATDPHSIAERLRREKISDRMKNLQDLVPNSNKAD--KASMLDEIIDYVKFLQLQVKV
G3751  (1112) -RRGQATDPHSIAERLRREKISDRMKDLQELVPNSNKTN--KASMLDEIIDYVKFLQLQVKV
G793   (1113) -RRGQATDPHSIAERLRRERIAERIRSLQELVPTVNKTD--RAAMIDEIVDYVKFLRLQVKV
G591   (1114) -RRGQATDPHSIAERLRRERIAERIRALQELVPTVNKTD--RAAMIDEIVDYVKFLRLQVKV
G3750  (1115) ARRGQATDPHSIAERLRRERIAERMRALQELVPNTNKTD--RAAMLDEILDYVKFLRLQVKV
G3760  (1116) ARRGQATDPHSIAERLRRERIAERMKALQELVPNANKTD--KASMLDEIVDYVKFLQLQVKV
G3774  (1117) ARRGQATDPHSIAERLRRERIAERMKALQELVPNANKTD--KASMLDEIIDYVKFLQLQVKV
G1134  (1118) -KRGCATHPRSIAERVRRTRISDRIRKLQELVPNMDKQT-NTADMLEEAVEYVKVLQRQIQ-
G2555  (1119) -KRGCATHPRSIAERVRRTRISDRIRRLQELVPNMDKQT-NTADMLEEAVEYVKALQSQIQ-
G3771  (1120) -KRGCATHPRSIAERVRRTRISDRIRKLQELVPNMDKQT-NTADMLDEAVAYVKFLQKQIE-
G3782  (1121) -KRGCATHPRSIAERVRRTRISERMRKLQELVPNSDKQTVNIADMLDEAVEYVKSLQKQVQ-
G3767  (1122) -KRGCATHPRSIAERVRRTKISERMRKLQDLVPNMDKQT-NTADMLDLAVDYIKDLQKQVQ-
G3768  (1123) -KRGCATHPRSIAERVRRTKISERMRKLQDLVPNMDKQT-NTADMLDLAVDYIKDLQKQVQ-
G3769  (1124) -KRGCATHPRSIAERVRRTKISERMRKLQDLVPNMDKQT-NTADMLDLAVEYIKDLQNQVQ-
G3086  (1125) -KRGCATHPRSIAERVRRTKISERMRKLQDLVPNMDTQT-NTADMLDLAVQYIKDLQEQVK-
G3744  (1126) -KRGCATHPRSIAERVRRTRISERIRKLQELVPNMDKQT-NTADMLDLAVDYIKDLQKQVK-
G3742  (1127) -KRGCATHPRSIAERVRRTRISERIRKLQELVPNMEKQT-NTADMLDLAVDYIKELQKQVK-
G3755  (1128) -KRGCATHPRSIAERVRRTKISERIRKLQELVPNMDKQT-NTSDMLDLAVDYIKDLQKQVK-
G592   (1129) -KRGCATHPRSIAERVRRTRISERMRKLQELVPNMDKQT-NTSDMLDLAVDYIKDLQRQYK-
G3766  (1130) -KRGCATHPRSIAERVRRTRISERMRKLQELVPHMDKQT-NTADMLDLAVEYIKDLQKQFK-
G3765  (1131) -KRGFATHPRSIAERVRRTRISERIRKLQELVPTMDKQT-STAEMLDLALDYIKDLQKQFK-
G3740  (1132) -KRGCATHPRSIAERERRTRISEKLRKLQELVPNMDKQT-STADMLDLAVEHIKGLQSQLQ-
G3741  (1133) -KRGCATHPRSIAERERRTRISEKLRKLQALVPNMDKQT-STSDMLDLAVDHIKGLQSQLQ-
G3772  (1134) -KRGCATHPRSIAERERRTRISGKLKKLQDLVPNMDKQT-SYADMLDLAVQHIKGLQTQVQ-
G2149  (1135) -KRGCATHPRSIAERERRTRISGKLKKLQDLVPNMDKQT-SYSDMLDLAVQHIKGLQHQLQ-
G2766  (1136) -KRGFATHPRSIAERERRTRISGKLKKLQELVPNMDKQT-SYADMLDLAVEHIKGLQHQVE-
G3746  (1137) -KRGCATHPRSIAERERRTRISKRLKKLQDLVPNMDKQT-NTSDMLDIAVTYIKELQGQVE-
G3763  (1138) -KRGFATHPRSIAERERRTRISARIKKLQDLFPKSDKQT-STADMLDLAVEYIKDLQKQVK-
G3764  (1139) -KRGFATHPRSIAERVRRTRISERIKKLQDLFPKSEKQT-STADMLDLAVEYIKDLQQKVK-
G1131  (1140) -SKKPTLSSQSIAARGRRRRIAEKTHELGKLIPGGNKLN--TAEMFQAAAKYVKFLQSQVGI
```

Fig. 12

Sequence
Name (SEQ ID NO.)

```
G3810  Gm  (212)  ----------------------------------------------------------
G3811  Gm  (214)  ----------------------------------------------------------
G3824  Le  (220)  ----------------------------------------------------------
G922   At    (4)  ----------------------------------------------------------
G3812  Gm (1141)  ----------------------------------------------------------
G3814  Os  (218)  ----------------------------------------------------------
G3813  Os  (216)  ----------------------------------------------------------
G3827  Os  (222)  ----------------------------------------------------------
G306   At (1142)  MAESG---DFN---GGQPPPHSPLRTTSSGSSSS-----NNRGPPPPPPPPLVMVRKRLA
G3821  Ps (1143)  MAACA---LFNGVGGGNTTPDETNNNSTSNSSNISTEDFHNMPQQQPHHSERKLLRKRMA
G3822  Zm (1144)  MPPPPPPPPLTPYCRRCPPPHLPPPPPSSPNHFLLH---YLHQLDHQEAAAAAMVRKRPA
G2738  At (1145)  ----------------------------------------------------------
G3009  At (1146)  ----------------------------------------------------------
G307   At (1147)  ----------------------------------------------------------
G308   At (1148)  ----------------------------------------------------------
G309   At (1149)  ----------------------------------------------------------
G3816  Ta (1150)  ----------------------------------------------------------
G3817  Os (1151)  ----------------------------------------------------------
G3818  Gm (1152)  ----------------------------------------------------------
G3010  At (1153)  ----------------------------------------------------------
G3826  Le (1154)  ----------------------------------------------------------
G644   At (1155)  ----------------------------------------------------------
G3823  Os (1156)  ----------------------------------------------------------
G3820  Os (1157)  ----------------------------------------------------------
G1768  At (1158)  ----------------------------------------------------------
G3815  Os (1159)  ----------------------------------------------------------
G3825  Le (1160)  ----------------------------------------------------------
```

Fig. 14A

| Sequence Name | (SEQ ID NO.) | |
|---|---|---|
| G3810 Gm | (212) | ------------------------------------------------- |
| G3811 Gm | (214) | ------------------------------------------------- |
| G3824 Le | (220) | ------------------------------------------------- |
| G922 At | (4) | ------------------------------------------------- |
| G3812 Gm | (1141) | ------------------------------------------------- |
| G3814 Os | (218) | ------------------------------------------------- |
| G3813 Os | (216) | ------------------------------------------------- |
| G3827 Os | (222) | ------------------------------------------------- |
| G306 At | (1142) | SEMSSNPDYNNSS----RPPRRVS------------------------- |
| G3821 Ps | (1143) | SEMELQLHNNNNNNDYHRFSRRTNNTSSLNCSLPATTQKGVTTTTTTTLASSGNNNNNNN |
| G3822 Zm | (1144) | SDMDLPPPRRHVT------------------------------------ |
| G2738 At | (1145) | ------------------------------------------------- |
| G3009 At | (1146) | ------------------------------------------------- |
| G307 At | (1147) | ------------------------------------------------- |
| G308 At | (1148) | ------------------------------------------------- |
| G309 At | (1149) | ------------------------------------------------- |
| G3816 Ta | (1150) | ------------------------------------------------- |
| G3817 Os | (1151) | ------------------------------------------------- |
| G3818 Gm | (1152) | ------------------------------------------------- |
| G3010 At | (1153) | ---------------------------------------MGSYPDGFPG |
| G3826 Le | (1154) | ---------------------------------------MEALFQEQLFP |
| G644 At | (1155) | ---------------------------------------MITEPSLTGISG |
| G3823 Os | (1156) | ------------------------------------------------- |
| G3820 Os | (1157) | ------------------------MVIELPFDNQYTTTETEQPHDGS |
| G1768 At | (1158) | ------------------------------------------------- |
| G3815 Os | (1159) | ------------------------------------------------- |
| G3825 Le | (1160) | ------------------------------------------------- |

Fig. 14B

Sequence
Name (SEQ ID NO.)

```
G3810 Gm  (212)  ------------------------------------------------------
G3811 Gm  (214)  ------------------------------------------------------
G3824 Le  (220)  ------------------------------------------------------
G922  At  (4)    ------------------------------------------------------
G3812 Gm  (1141) ------------------------------------------------------
G3814 Os  (218)  ------------------------------------------------------
G3813 Os  (216)  ------------------------------------------------------
G3827 Os  (222)  ------------------------------------------------------
G306  At  (1142) -----HLLDSNYN---------------TVTPQQPPSLTAAATVSSQPNP----------
G3821 Ps  (1143) NNNNYHYHNNNNNSIINNNNNNVALSRDNVAIQNFPTVTVTTNYSTMLLPSSCSSNLNNS
G3822 Zm  (1144) ----------------------------GDLSDVTAAAAAGVGGSGAP----------
G2738 At  (1145) ------------------------------------------------------
G3009 At  (1146) ------------------------------------------------------
G307  At  (1147) ------------------------------------------------------
G308  At  (1148) ------------------------------------------------------
G309  At  (1149) ------------------------------------------------------
G3816 Ta  (1150) ------------------------------------------------------
G3817 Os  (1151) ------------------------------------------------------
G3818 Gm  (1152) ------------------------------------------------------
G3010 At  (1153) SMDELDFNKDFDLPPSSNQT-LGLANGFYLDD---LDFSSLDPP-EAYPSQNNNNNNINN
G3826 Le  (1154) CADSFIFR--HPSIPMDPRK-EVIQNG--LNNHPSFDQDYFSNHVVGVGDSSPP------
G644  At  (1155) MVNRNRLSGLPDQPSSHSFTPVTLYDGFNYNLSSDHINTVVAAPENSVFIREEEEE----
G3823 Os  (1156) ---------------------------MDSPEYCQTNSNIT-----------
G3820 Os  (1157) SCSSQQQLSLYNYSPSDPQLFSQPTTGSRTYLSGAVTIPGICNDKSNLGQQQFQIDAA--
G1768 At  (1158) ------------------------------------------------------
G3815 Os  (1159) ------------------------------------------------------
G3825 Le  (1160) ------------------------------------------------------
```

Fig. 14C

| Sequence Name | (SEQ ID NO.) | |
|---|---|---|
| G3810 Gm | (212) | ------------------------------------------------------------ |
| G3811 Gm | (214) | ------------------------------------------------------------ |
| G3824 Le | (220) | ------------------------------------------------------------ |
| G922 At | (4) | ------------------------------------------------------------ |
| G3812 Gm | (1141) | ------------------------------------------------------------ |
| G3814 Os | (218) | ------------------------------------------------------------ |
| G3813 Os | (216) | ------------------------------------------------------------ |
| G3827 Os | (222) | ------------------------------------------------------------ |
| G306 At | (1142) | ------------PLS--------VCGFSGLPVFPSDRGGRNVMMSVQPMDQDSS------ |
| G3821 Ps | (1143) | STSAANYTHYQQPLVEEQNTLPEICGFSGLPLFPSQNNQTNRTNNNSSNNRNNTNTVVDV |
| G3822 Zm | (1144) | ----------------------SSASAQLPALPTQLHQLPPAFQHHAPEVDVPAHPAPA |
| G2738 At | (1145) | ------MKRGYGETWDPPPK---PLPASRSGEGPSMADKKKADDDNNNSNMDDELLAVLG |
| G3009 At | (1146) | ------MKRSHQET-------------SVEEEAPSMVEKLENGCGGGGDDNMDEFLAVLG |
| G307 At | (1147) | ------MKRDHHQFQGRLSNHGTSSSSSSISKDKMMMVKKEEDGGGN---MDDELLAVLG |
| G308 At | (1148) | ------MKRDHHHHHQ---------------DKKTMMMNEEDDGNG-----MDELLAVLG |
| G309 At | (1149) | ------MKREHNHRES----------SAGEGGSSSMTTVIKEEAAG-----VDELLVVLG |
| G3816 Ta | (1150) | ------MKREYQDAGG-------SGGGG--GGMGSSEDKMMVSAAAGEGEEVDELLAALG |
| G3817 Os | (1151) | ------MKREYQEAGG-------SSGGGSSADMGSCKDKVMAG-AAGEEEDVDELLAALG |
| G3818 Gm | (1152) | ----------------------------------MASSSSNGSSSGSKSWDIDGDLAGFG |
| G3010 At | (1153) | KAVAGDLLSSSSDDADFSDSVLKYISQVLMEED-MEEKPCMFHDALALQAAAEKSLYEALG |
| G3826 Le | (1154) | --------PQEEGEKDYSDAMYKFLSQMLMEEDDLENKPCMFHDCMALQAKERYLSDVLH |
| G644 At | (1155) | --------EDPADDFDFSDAVLGYISQMLNEED-MDDKVCMLQESLDLEAAERSLYEAIG |
| G3823 Os | (1156) | --------------------LDYINRILMEED-IDEKISIKKGQDALQATEKPFYDILG |
| G3820 Os | (1157) | --------LSLGYQRIRSSDALCYISRVLMED--VDERVDLHQGEAALQAAEKPFYDILG |
| G1768 At | (1158) | ------------------------------------------------------------ |
| G3815 Os | (1159) | ----------------------------------MPYYNNSVPSGGNGRFYITQNHQDAH |
| G3825 Le | (1160) | ----------------------------------MDSHHLVAYGVTGSDLSYSSCPTVSP |

Fig. 14D

| Sequence Name | (SEQ ID NO.) | |
|---|---|---|
| G3810 Gm | (212) | ------------------------------------------------------------ |
| G3811 Gm | (214) | ------------------------------------------------------------ |
| G3824 Le | (220) | ------------------------------------------------------------ |
| G922 At | (4) | ------------------------------------------------------------ |
| G3812 Gm | (1141) | ------------------------------------------------------------ |
| G3814 Os | (218) | ------------------------------------------------------------ |
| G3813 Os | (216) | ------------------------------------------------------------ |
| G3827 Os | (222) | ------------------------------------------------------------ |
| G306 At | (1142) | -SSS------ASPTVWVDAIIRDLIHSS--TSVSIPQLIQNVRDIIFPCNPNLGALLEYR |
| G3821 Ps | (1143) | VSSSPSMEETSATTNWIDGILKDLIHTS--NSVSIPQLINNVREIIYPCNPNLALVLEHR |
| G3822 Zm | (1144) | AHAQAGGEATASTTAWVDGIIRDIIGSSGGAAVSITQLIHNVREIIHPCNPGLASLLELR |
| G2738 At | (1145) | YKVRSSEMAEVAQKLEQLEMVLSN---------DDVG-STVLNDSVHYNPSDLSNWVES- |
| G3009 At | (1146) | YKVRSSDMADVAQKLEQLEMVLSN---------DIASSSNAFNDTVHYNPSDLSGWAQS- |
| G307 At | (1147) | YKVRSSEMAEVALKLEQLETMMSNV--------QEDGLSHLATDTVHYNPSELYSWLDN- |
| G308 At | (1148) | YKVRSSEMADVAQKLEQLEVMMSNV--------QEDDLSQLATETVHYNPAELYTWLDS- |
| G309 At | (1149) | YKVRSSDMADVAHKLEQLEMVLG-----------DGISNLSDETVHYNPSDLSGWVES- |
| G3816 Ta | (1150) | YKVRASDMADVAQKLEQLEMAMGMGGVGAGAAPDDSFATHLATDTVHYNPTDLSSWVES- |
| G3817 Os | (1151) | YKVRSSDMADVAQKLEQLEMAMGMGGVSAPGAADDGFVSHLATDTVHYNPSDLSSWVES- |
| G3818 Gm | (1152) | YKVRSSELQHVAENMERLENVMDIVN-----SSTNNNISQLASDTVFYNPSDIGSWVDT- |
| G3010 At | (1153) | EKYPSSSSASSVDHPERLASDSPDGSCSGGAFSDYASTTTTTSSDSHWSVDGLEN-RPS- |
| G3826 Le | (1154) | GSENNYSPQSVIINPHDSSS----------FLSNYSPDSIESP---QWDLN--------- |
| G644 At | (1155) | KKYPP-SPERNLAFAERNSE----------NLDRVVPGNYTGGDCIGFGNGGIKPLSSG- |
| G3823 Os | (1156) | KAYPSSSKETAINGDSQADYP---------DNGSS--SYHEQACSGSFVSDLLGSQ---- |
| G3820 Os | (1157) | QVYPPSLNRLALHSANEPDTP---------DESSSRNNYHNRYHSSHSSFNMLQPLPTP- |
| G1768 At | (1158) | ------------------------------------MDNVR------GSIMLQPLPEI- |
| G3815 Os | (1159) | YASSDDGSQKIGSSPQAFEAP-----YCTLESSSANGAHPAH------SSASSHSISPI- |
| G3825 Le | (1160) | LENRPFGTSKFDSGNSPLVNY-----FNSETFNTVSDYQEQP------SCTENLSGASS- |

Fig. 14E

| Sequence Name | (SEQ ID NO.) | |
|---|---|---|
| G3810 Gm | (212) | ------------------------------------------------------------ |
| G3811 Gm | (214) | ------------------------------------------------------------ |
| G3824 Le | (220) | ------------------------------------------------------------ |
| G922 At | (4) | ------------------------------------------------------------ |
| G3812 Gm | (1141) | ------------------------------------------------------------ |
| G3814 Os | (218) | ------------------------------------------------------------ |
| G3813 Os | (216) | ------------------------------------------------------------ |
| G3827 Os | (222) | ------------------------------------------------------------ |
| G306 At | (1142) | LRSL----------------------------------------------------MLL |
| G3821 Ps | (1143) | LRLLTEPNTCVPERKRNSTEQSGVN-------------------------VNGNVL |
| G3822 Zm | (1144) | LRSL----------------------------------------------------LAA |
| G2738 At | (1145) | ---------------------------------------------------------MLS |
| G3009 At | (1146) | ---------------------------------------------------------MLS |
| G307 At | (1147) | ---------------------------------------------------------MLS |
| G308 At | (1148) | ---------------------------------------------------------MLT |
| G309 At | (1149) | ---------------------------------------------------------MLS |
| G3816 Ta | (1150) | ---------------------------------------------------------MLS |
| G3817 Os | (1151) | ---------------------------------------------------------MLS |
| G3818 Gm | (1152) | ---------------------------------------------------------LLS |
| G3010 At | (1153) | WLHTPMPSNFVFQSTSRSNSVTGGGGGGNSAVYGSGFGDDL---VSNMFKDDELAMQFKK |
| G3826 Le | (1154) | -----------FESPASMSTLS------NHDSFFTSFGNG---------------HFEE |
| G644 At | (1155) | -------FTLDFRNPQSCSSILSVP---QSNGLITIYGDGIDESSKNNRENHQSVWLFRR |
| G3823 Os | (1156) | ---------------------------DAHSITTDWSSEFD---------RLALQFRR |
| G3820 Os | (1157) | -----------LSPYSYGRSLFLP---NQHLVSTAWTSTFG---------IPGFQIRR |
| G1768 At | (1158) | ---------------------------------------------------------AES |
| G3815 Os | (1159) | ---------------------------------------------------------SGS |
| G3825 Le | (1160) | ---------------------------------------------------------SSG |

Fig. 14F

```
Sequence
Name    (SEQ ID NO.)
G3810 Gm   (212)  ----------------------------------------------------------------
G3811 Gm   (214)  ----------------------------------------------------------------
G3824 Le   (220)  ----------------------------------------------------------------
G922  At     (4)  ----------------------------------------------------------------
G3812 Gm  (1141)  ----------------------------------------------------------------
G3814 Os   (218)  ----------------------------------------------------------------
G3813 Os   (216)  ----------------------------------------------------------------
G3827 Os   (222)  ----------------------------------------------------------------
G306  At  (1142)  DPSSSSDPSPQTFE-------------------------------------------PLYQI
G3821 Ps  (1143)  AASNVNNSSVKLMN-------------------------------------------RVDDV
G3822 Zm  (1144)  DPAPLPPPPQPQQH-------------------------------------------ALLHG
G2738 At  (1145)  ELNNPASSDLDT--------------------------------------------------
G3009 At  (1146)  DLN--YYPDLDP--------------------------------------------------
G307  At  (1147)  ELNPPPLPASSNGL------------------------------------------------
G308  At  (1148)  DLNPP----SSN--------------------------------------------------
G309  At  (1149)  DLDPTRIQEKPD--------------------------------------------------
G3816 Ta  (1150)  ELNAPPPPLPPAP--QLNASTSS----------------------------------TVTGSGG
G3817 Os  (1151)  ELNAPLPPIPPAPPAARHASTSS----------------------------------TVTGGGG
G3818 Gm  (1152)  EFDQTAS-------------------------------------------------------
G3010 At  (1153)  GVEEASKFLPKSSQLFIDVDSYIPMNSGSKENGSEVFVKTEKKDETEHHHHHSYAPPPNR
G3826 Le  (1154)  GAVNVLQSGSSSN--------------------------------------------SPTG
G644  At  (1155)  EIEEANRFNPEENELIVNFR-------------------------------------EENC
G3823 Os  (1156)  GVEEAKRFIPNIEKLVDDPEKN--------------GLYACKQTTETTE--QKGKHENK
G3820 Os  (1157)  GAEEAKRFVPIIDKLVIDLDTDR-------------GLSISKMTTKAKVGDKKRYAIFE
G1768 At  (1158)  ----------------------------------------------------------------
G3815 Os  (1159)  PLSHHDSHSDHT--------------------------------------------------
G3825 Le  (1160)  SSLDYNQYFHRP--------------------------------------------------
```

Fig. 14G

| Sequence Name | (SEQ ID NO.) | |
|---|---|---|
| G3810 Gm | (212) | ------------------------------------------------------------- |
| G3811 Gm | (214) | ------------------------------------------------------------- |
| G3824 Le | (220) | ------------------------------------------------------------- |
| G922 At | (4) | ----------------------------------------------------MVAMFQEDNG |
| G3812 Gm | (1141) | ------------------------------------------------------------- |
| G3814 Os | (218) | --------------------------------------------------------MFQDDML |
| G3813 Os | (216) | ---------------------------------------------------------MVQDEGS |
| G3827 Os | (222) | ---------------------------------------------------------MIT-FGL |
| G306 At | (1142) | S------NNPSPPQQQQQHQ---------QQQQQHKP-------PPPPIQQQERENS-ST |
| G3821 Ps | (1143) | VPTSLHFSDSSTLLNQNQNQNMFPNWGATQINNNNNPSVSLVTLPSQPLSTQQDQQH-QL |
| G3822 Zm | (1144) | APAAAPAGLTLPPPPPLPDK---------RRHEHPP-------PCQQQQQEEPHPAPQS |
| G2738 At | (1145) | -------TRSCVDRSEYDLRAIPGLSAFPKEEEVF----------------DEEASSKR |
| G3009 At | (1146) | -------NRIC------DLRPIT-----DDDECCS----------------SNSNSNKR |
| G307 At | (1147) | DPVLPSPEICGFPASDYDLKVIPGNAIYQFPAIDSSSSSNNQNKRLKSCSSPDSMVTSTS |
| G308 At | (1148) | -------------AEYDLKAIPGDAILNQFAIDSASSSNQG-------GGGDTYTTNKR |
| G309 At | (1149) | -------------SEYDLRAIPGSAVYPR----------------------DEHVTRRS |
| G3816 Ta | (1150) | --YFDLPPSVDSSSSIYALRPIPSPAGATAPADLSADSVRDPKRMRTGGSSTSSSSSSSS |
| G3817 Os | (1151) | SGFFELPAAADSSSSTYALRPISLPVVATADPS-AADSARDTKRMRTGGGSTSSSSSSSS |
| G3818 Gm | (1152) | -------------LPYDFSDFLD------------------------------------ |
| G3010 At | (1153) | LTGKKSHWRDEDEDFVEERSNKQSAVYVEES-ELSEMFDKILVCGPGK--------PVCI |
| G3826 Le | (1154) | LREKKNRHR-GDVAADQQRSNKQMATFVHDESEPLEMYDNVLLCLNNP----------YV |
| G644 At | (1155) | VSKARKNSSRDEICVEEERSSKLPAVFGEDI-LRSDVVDKILVHVPGGESMKEFNALRDV |
| G3823 Os | (1156) | IRNHPHDPHVEHIELMEARNSKHMAISTSET-IRDEMFDSILLCN-RQLPG-----EVAN |
| G3820 Os | (1157) | LTDQRHSPYTTDLDILEGRNSKRYAITYCEI-IRNDMFDRVLLCYGVENFA-----EASN |
| G1768 At | (1158) | ----------------------------IDDAIC-HELSMWPDDA-------------- |
| G3815 Os | (1159) | -----YNSPPSASCVTEITDLQIKLRELENAILGPELDIAYDSP--------------- |
| G3825 Le | (1160) | -----SPSEDHLPEAPYSRNMKHTLLQLESALMGPDKEAMKSSPYLGENMGAQTSGQRYK |

Fig. 14H

```
Sequence
Name    (SEQ ID NO.)
G3810 Gm   (212)  -------------MMSL--SPSLGSPN-NLLFREMKSEERGLYLIHLLLTCANHVA--AG
G3811 Gm   (214)  -------------MMSLSVSPSLGSP------YHMKCELRGLVLIHLLLAGANFVA--TG
G3824 Le   (220)  -------------------------------------------------------------
G922  At   (4)    TSSVASSPLQVFSTMSLNRPTLLASSSPFHCLKDLKPEERGLYLIHLLLTCANHVA--SG
G3812 Gm   (1141) ------------------MDGLGSPS--QWLRELRWDSQGLNPISLLIDCAKCVA--SG
G3814 Os   (218)  SSATS--------SPASSVYSPSPSPSNGSWVQELSHDQQSVRLIGLLYQCAAEVS--AG
G3813 Os   (216)  SSSVTSSPLHNFSNMPLHPAAAASPTPPWMVRELR-SDERGLCLIHLLLNCAAAAA--AG
G3827 Os   (222)  NSRPHPEFRNDLRPSSSSLAAGESESPKAVERLEREGCTRSGSSRRQPRRGAAAAL--AV
G306  At   (1142) DAPPQPETVTATVPAVQTNTAEALRERKEEIKRQKQ-DEEGLHLLTLLLQCAEAVS--AD
G3821 Ps   (1143) QQHP-EDLAPATTTTTTSAELALARKKKEEIKEQKKKDEEGLHLLTLLLQCAEAVS--AE
G3822 Zm   (1144) PKAPTAEETAAAAAAAQAAAAAAAAKERKEEQRRKQR-DEEGLHLLTLLLQCAEAVN--AD
G2738 At   (1145) IRLG--------------SWCESSD-ESTRSVVLVDSQETGVRLVHALVACAEAIH--QE
G3009 At   (1146) IRLG--------------PWCDSVTSESTRSVVLIE--ETGVRLVQALVACAEAVQ--LE
G307  At   (1147) TGTQIGGVIGTTVTT--TTTTTTAAAESTRSVILVDSQENGVRLVHALMACAEAIQ--QN
G308  At   (1148) LKCSNG-----------VVETTTATAESTRHVVLVDSQENGVRLVHALLACAEAVQ--KE
G309  At   (1149) K----------------RTRIESELSSTRSVVVLDSQETGVRLVHALLACAEAVQ--QN
G3816 Ta   (1150) SLGGGA-RSSVVEAAPPVAAAANAT--PALPVVVVDTQEAGIRLVHALLACAEAVQ--QE
G3817 Os   (1151) SLGGGASRGSVVEAAPPATQGAAAANAPAVPVVVVDTQEAGIRLVHALLACAEAVQ--QE
G3818 Gm   (1152) -------------------LDTDQNQNHKPTLVTMEEDSGIRLVHTLMTCADSVQ--RG
G3010 At   (1153) LNQNFPTESAKVVTAQSNGAKIRGKKST-STSHSNDSKKETADLRTLLVLCAQAVS--VD
G3826 Le   (1154) EQHSATSITSYSPPNEAKKTSKVGRPRG-GRKHSSIVKKEMVDLRALLTQCAQAMA--NY
G644  At   (1155) LKKGVEKKKASDAQGGKRRARGRGRGRGRGGGGGQNGKKEVVDLRSLLIHCAQAVA--AD
G3823 Os   (1156) LRGMMAKEASDNPKKFQSKGYGKGQRKP---HSSKKKQKEAIDLSVLLIQCAQAIA--SN
G3820 Os   (1157) LRKIMTKQARKNSLNGQTR--GSAQRKL---RGMKQLKKDVVDLRNLLIHCAQAVA--AD
G1768 At   (1158) ------------------KDLLL-----------IVEAISRGDLKLVLVACAKAVS--EN
G3815 Os   (1159) ------------------ESALQPNIMATPENWRQLLGINTGDLKQVIIACGKAVA--EN
G3825 Le   (1160) AWNKEAQVVRHQQSVVSILNGIQSDKRDNVMEDLPLQGVPSSNLKQLLIACARALA--EN
```

Fig. 141

| Sequence Name | (SEQ ID NO.) | |
|---|---|---|
| G3810 Gm | (212) | NLENANTTLEQISMLASPDG--DTMQRIATYFMESLADRILKTWPGIHR-----ALNS-- |
| G3811 Gm | (214) | DLQYAYLTLEQISQHASLDG--DTMQRIASYVSEALADRILKTWPGIHR-----ALNS-- |
| G3824 Le | (220) | ----------------------MQRIASYFTEALADRILRSWPGLYK-----ALRS-- |
| G922 At | (4) | SLQNANAALEQLSHLASPDG--DTMQRIAAYFTEALANRILKSWPGLYK-----ALNATQ |
| G3812 Gm | (1141) | SIKNADIGLEYISQISSPDG--NAVQRMVTYFSEALGYRIIKNLPGVYK-----SLNP-- |
| G3814 Os | (218) | SFDRANLCLEHITQLASLDAP-HALQRLAAVFADALARKLLNLILGLSR-----ALLSS- |
| G3813 Os | (216) | RLDAANAALEHIASLAAPDG--DAMQRVAAAFAEALARRALRAWPGLCR-----ALLLP- |
| G3827 Os | (222) | ASAPSLASCCRRPSIRKLLS--LPLHARPVPPPGSGMRQPLRPSPAALHPR--GAAVAP- |
| G306 At | (1142) | NLEEANKLLLEISQLSTPYG--TSAQRVAAYFSEAMSARLLNSCLGIYAA----LPSRWM |
| G3821 Ps | (1143) | NLEQANKMLLEISQLSTPFG--TSAQRVAAYFSEAISARLVSSCLGIYAT----LPVSSH |
| G3822 Zm | (1144) | NLDDAHQTLLEIAELATPFG--TSTQRVAAYFAEAMSARLVSSCLGLYAP----LPPGSP |
| G2738 At | (1145) | NLNLADALVKRVGTLAGSQAG--AMGKVATYFAQALARRIYRDYTAETDVC--------- |
| G3009 At | (1146) | NLSLADALVKRVGLLAASQAG--AMGKVATYFAEALARRIYRIHPSA------------ |
| G307 At | (1147) | NLTLAEALVKQIGCLAVSQAG--AMRKVATYFAEALARRIYRLSPPQ------------- |
| G308 At | (1148) | NLTVAEALVKQIGFLAVSQIG--AMRQVATYFAEALARRIYRLSPSQ------------- |
| G309 At | (1149) | NLKLADALVKHVGLLASSQAG--AMRKVATYFAEGLARRIYRIYPRD------------- |
| G3816 Ta | (1150) | NLSAAEALVKQIPLLAASQGG--AMRKVAAYFGEALARRVFRFRPQPDS----------- |
| G3817 Os | (1151) | NFAAAEALVKQIPTLAASQGG--AMRKVAAYFGEALARRVYRFRP-ADS----------- |
| G3818 Gm | (1152) | DLAFAGSLIENMQGLLAHVNTNIGIGKVAGYFIDALRRRILGQGVFQTLS---------- |
| G3010 At | (1153) | DRRTANEMLRQIREHSSPLGN--GSERLAHYFANSLEARLAGTGTQIYTA--------LS |
| G3826 Le | (1154) | DSRTANELLMRIREHSTPHGD--GTERLAHYLANALEARLSGTGTALYTA--------YA |
| G644 At | (1155) | DRRCAGQLLKQIRLHSTPFGD--GNQRLAHCFANGLEARLAGTGSQIYKG--------IV |
| G3823 Os | (1156) | NHPFASELLRKIRHHALPDGD--GSQRLANCFADGLEARLAGTGSQMYEK--------LM |
| G3820 Os | (1157) | DRISASELVKKIRQHSSPDGD--SNQRLAFYLVDGLEARLAGIGSQVYRK--------LM |
| G1768 At | (1158) | NLLMARWCMGELRGMVSISGE--PIQRLGAYMLEGLVARLAASGSSIYKS--------LQ |
| G3815 Os | (1159) | DVRLTELLISELGQMVSVSGD--PLQRLGAYMLEGLVARLSSSGSKIYKS--------LK |
| G3825 Le | (1160) | KLDDFEILVAKARSVVSVTGD--PIQRLGAYIVEGLVARKELSGTTIYRS--------LK |

Fig. 14J

Sequence
Name    (SEQ ID NO.)

G3810 Gm   (212)   TRMTLISDEILVQKLFFELFPFLKVAFVLTNQAIIEAMEGEK--VIHIIDLN----AAEA
G3811 Gm   (214)   SRITMVSDEILVQKLFFELLPFLKFSYILTNQAIVEAMEGEK--MVHIVDLY----GAGP
G3824 Le   (220)   TKLSVVSEEILVRKMFFEIFPFLKVAFVVTNQAIIEAMEGEK--MVHIVDLN----AAEP
G922  At    (4)    TRTNNVSEEIHVRRLFFEMFPILKVSYLLTNRAILEAMEGEK--MVHVIDLD----ASEP
G3812 Gm  (1141)   SKTSLSSEDILVQKYFYELCPFLKFSYLITNHAIAEAMECEK--VVHIIDLH----CCEP
G3814 Os   (218)   ANSADAHLVPVARRHMFDVLPFLKLAYLTTNHAILEAMEGER--FVHVVDFSG--PAANP
G3813 Os   (216)   RASPTPAEVAAARRHFLDLCPFLRLAGAAANQSILEAMESEK--IVHVIDLG----GADA
G3827 Os   (222)   TRSPGAAVAGAEMRQQVSYC-WRPVRPPPAGG---EEAGGEL--LLRGREL---------
G306  At  (1142)   PQT-HSLKMVSAFQVFNGISPLVKFSHFTANQAIQEAFEKED--SVHIIDLD----IMQG
G3821 Ps  (1143)   TP--HNQKVASAFQVFNGISPFVKFSHFTANQAIQEAFEREE--RVHIIDLD----IMQG
G3822 Zm  (1144)   AAARLHGRVAAAFQVFNGISPFVKFSHFTANQAIQEAFEREE--RVHIIDLD----IMQG
G2738 At  (1145)   -AAVNPSFEEVLEMHFYESCPYLKFAHFTANQAILEAVTTAR--RVHVIDLG----LNQG
G3009 At  (1146)   -AAIDPSFEEILQMNFYDSCPYLKFAHFTANQAILEAVTTSR--VVHVIDLG----LNQG
G307  At  (1147)   -NQIDHCLSDTLQMHFYETCPYLKFAHFTANQAILEAFEGKK--RVHVIDFS----MNQG
G308  At  (1148)   -SPIDHSLSDTLQMHFYETCPYLKFAHFTANQAILEAFQGKK--RVHVIDFS----MSQG
G309  At  (1149)   -DVALSSFSDTLQIHFYESCPYLKFAHFTANQAILEVFATAE--KVHVIDLG----LNHG
G3816 Ta  (1150)   -SLLDAAFADLLHAHFYESCPYLKFAHFTANQAILEAFAGCR--RVHVVDFG----IKQG
G3817 Os  (1151)   -TLLDAAFADLLHAHFYESCPYLKFAHFTANQAILEAFAGCH--RVHVVDFG----IKQG
G3818 Gm  (1152)   -SSSYPYEDNVLYHHYYEACPYLKFAHFTANQAILEAFNGHD--CVHVIDFN----LMQG
G3010 At  (1153)   SKKTSAADMLKAYQTYMSVCPFKKAAIIFANHSMMRFT--ANANTIHIIDFG----ISYG
G3826 Le  (1154)   PSRISAANILKAYKAFIRACPFKLLSNIFANKYIRKVI--AGAPKIHIIDFG----ILYG
G644  At  (1155)   SKPRSAAAVLKAHQLFLACCPFRKLSYFITNKTIRDLVG--NSQRVHVIDFG----ILYG
G3823 Os  (1156)   AKQTSTRDMLKAYHLYFVACPFEMVTYYFSNKTIIDALEGKT--TLHIVDFG----ILFG
G3820 Os  (1157)   ASRTSAESLLKAYSLYLSACPFERASFAYANQTILDASKGQQPRKVHIVHFG----ICTG
G1768 At  (1158)   SREPESYEFLSYVYVLHEVCPYFKFGYMSANGAIAEAMKDEE--RIHIIDFQ----IGQG
G3815 Os  (1159)   CKEPTSSELMSYMHLLYEICPFFKFGYMSANGAIAEAIKGEN--FVHIIDFQ----IAQG
G3825 Le  (1160)   CKEPAGKDLFSYMYILYEICPYLKFGYMAANGAIVEACRNED--RIHIIDFQ----IAQG

Fig. 14K

```
Sequence
Name    (SEQ ID NO.)

G3810 Gm  (212)  AQWIALLRVLSAHP--EGPPHLRITGVHQKK----------EILDEVAHRLTEEAEKLDI
G3811 Gm  (214)  AQWISLLQVLSARP--EGPPHLRITGVHHKK----------EVLDQMAHKLTEEAEKLDI
G3824 Le  (220)  LQWRALLQDLSARP--EGPPHLRITGVHQQK----------EVLDQMAHVLTQEAEKLDI
G922  At   (4)   AQWLALLQAFNSRP--EGPPHLRITGVHHQK----------EVLEQMAHRLIEEAEKLDI
G3812 Gm  (1141) TQWIDLLLTFKNRQ--GGPPHLKITGIHEKK----------EVLDQMNFHLTTEAGKLDF
G3814 Os  (218)  VQWIALFHAFRGRR--EGPPHLRITAVHDSK----------EFLANMAAVLSKEAEAFDI
G3813 Os  (216)  TQWLELLHLLAARP--EGPPHLRLTSVHEHK----------ELLTQTAMALTKEAERLDV
G3827 Os  (222)  -LLLQLLLIYLVWD--GGTLLLLELSIFFLL----------FCSLVTAMALTKEAERLDV
G306  At  (1142) LQWPGLFHILASRP--GGPPHVRLTGLGTSM----------EALQATGKRLSDFTDKLGL
G3821 Ps  (1143) LQWPGLFHILASRP--GGPPYVRLTGLGTSM----------ETLEATGKRLSDFANKLGL
G3822 Zm  (1144) LQWPGLFHILASRP--GGPPRVRLTGLGASM----------EALEATGKRLSDFADTLGL
G2738 At  (1145) MQWPALMQALALRP--GGPPSFRLTGIGPPQT------ENSDSLQQLGWKLAQFAQNMGV
G3009 At  (1146) MQWPALMQALALRP--GGPPSFRLTGVGNP--------SNREGIQELGWKLAQLAQAIGV
G307  At  (1147) LQWPALMQALALRE--GGPPTFRLTGIGPPAP------DNSDHLHEVGCKLAQLAEAIHV
G308  At  (1148) LQWPALMQALALRP--GGPPVFRLTGIGPPAP------DNFDYLHEVGCKLAHLAEAIHV
G309  At  (1149) LQWPALIQALALRP--NGPPDFRLTGIGYSLT------D----IQEVGWKLGQLASTIGV
G3816 Ta  (1150) MQWPALLQALALRP--GGPPSFRLTGVGPPQP------DETDALQQVGWKLAQFAHTIRV
G3817 Os  (1151) MQWPALLQALALRP--GGPPSFRLTGVGPPQP------DETDALQQVGWKLAQFAHTIRV
G3818 Gm  (1152) LQWPALIQALALRP--GGPPLLRLTGIGPPSS------DNRDTLREIGLRLAELARSVNV
G3010 At  (1153) FQWPALIHRLSLSRP-GGSPKLRITGIELPQRGF----RPAEEFRRQVIAWLDTVSDTMF
G3826 Le  (1154) FQWPCLIQGLSMRA--GGPPELRITGIDLPQPGF----KPAGRVEETGRRLEKYCKRFSV
G644  At  (1155) FQWPTLIHRFSMYG----SPKVRITGIEFPQPGF----RPAQRVEETGQRLAAYAKLFGV
G3823 Os  (1156) FQWPCLIQRLAKRE--GGPPKLRITGVDVPQPGF----RPHERIEETGKRLAEYANMFNV
G3820 Os  (1157) FQWPSLIQRLANEE--GGPPKLRITGIDMPQPGF----HPCEIIEETGKRLADYANLFKV
G1768 At  (1158) SQWIALIQAFAARP--GGAPNIRITGVGD-----------GSVLVTVKKRLEKLAKKFDV
G3815 Os  (1159) SQWMTLIQALAARP--GGPPFLRITGIDDSNSAY----ARGGGLDIVGMRLYKVAQSFGL
G3825 Le  (1160) TQWMTLLQALAARP--GGAPYVRITGIDDPVSQY----ARGDGLAAVARRLSAISEEFNI
```

Fig. 14L

Sequence
Name (SEQ ID NO.)

```
G3810 Gm  (212)  PFQFN--PVASKLENLDFDKLR-------VKTGEALAISSILQLHTLLAWDDEAMQRKSP
G3811 Gm  (214)  PFQFN--PVLSKLENLDFNKLR-------VKTGEALAISSIMQLHSLLALDEDASRRKSP
G3824 Le  (220)  PFQFN--QVVSRLENLDVEKLR-------VKTGEALAISSIMQLHTLLAHDNDK---KSP
G922  At    (4)  PFQFN--PVVSRLDCLNVEQLR-------VKTGEALAVSSVLQLHTFLASDDDLMRKNCA
G3812 Gm (1141)  PLQFY--PVVSKLEDVDFEKLP-------VKIGDALAISSVLQLHSLLATDDDMAGRISP
G3814 Os  (218)  AFQFN--AVEAKLDEMDFDALRHDLG---VRSGEALAVSVVLQLHRLLAVDDGR--RHAA
G3813 Os  (216)  PFQFN--PVVSRLDALDVESLRV-------KTGEALAICSSLQLHCLLASDDDA------
G3827 Os  (222)  PFQFN--PVVSRLDALDVESLR--------------------------------------
G306  At (1142)  PFEFC--PLAEKVGNLDTERLN-------VRKREAVAVHWLQHSLYDVTGSDAH------
G3821 Ps (1143)  PFEFF--PVAEKVGNIDVEKLN-------VSKSEAVAVHWLQHSLYDVTGSDTN------
G3822 Zm (1144)  PFEFC--AVAEKAGNVDPEKLG-------VTRREAVAVHWLHHSLYDVTGSDSN------
G2738 At (1145)  EFEFKG-LAAESLSDLEPEMFETRPE------SETLVVNSVFELHRLLARSG--------
G3009 At (1146)  EFKFNG-LTTERLSDLEPDMFETRTE------SETLVVNSVFELHPVLSQPG--------
G307  At (1147)  EFEYRG-FVANSLADLDASMLELRPSD-----TEAVAVNSVFELHKLLGRPG--------
G308  At (1148)  EFEYRG-FVANTLADLDASMLELRPSE-----IESVAVNSVFELHKLLGRPG--------
G309  At (1149)  NFEFKS-IALNNLSDLKPEMLDIRPG------LESVAVNSVFELHRLLAHPG--------
G3816 Ta (1150)  DFQYRG-LVAATLADLEPFMLQPEGEEDPNEEPEVIAVNSVFEMHRLLAQPG--------
G3817 Os (1151)  DFQYRG-LVAATLADLEPFMLQPEGEADANEEPEVIAVNSVFELHRLLAQPG--------
G3818 Gm (1152)  RFAFRG-VAAWRLEDVKPWMLQVNPN-------EAVAVNSIMQLHRLLASDSDPI-----
G3010 At (1153)  RLSTT--QLLRNGETIQVEDLKLR-------QGEYVVVNSLFRFRNLLDETVLVN-----
G3826 Le (1154)  PFVFK--AIAKKWESITLEELEVQ-------RDEVLVVNSLYRLGNIPDETVVPN-----
G644  At (1155)  PFEYK--AIAKKWDAIQLEDLDID-------RDEITVVNCLYRAENLHDESVKVE-----
G3823 Os (1156)  PFQYH--GIASRWETICIEDLSID-------KDEVLIINCMSRMRKLGDETENID-----
G3820 Os (1157)  PFQYQ--GIASRWETVQIEDLNID-------KDEVLIVNCMFRMKNLGDEMVSMN-----
G1768 At (1158)  PFRFN--AVSRPSCEVEVENLDVR-------DGEALGVNFAYMLHHLPDESVSME-----
G3815 Os (1159)  PFEFN--AVPAASHEVYLEHLDIR-------VGEVIVVNFAYQLHHTPDESVSTE-----
G3825 Le (1160)  AVEFH--AVPVFAPEITWDMLDVR-------PGEALAVNFPLQLHHTPDESVDVN-----
```

Fig. 14M

Sequence
Name     (SEQ ID NO.)

```
G3810 Gm  (212)  LLLKSS-NGIHLQRVLPMGQSTLGDLLEKDMVN----------GYTPSPDSTSSSPSSLT
G3811 Gm  (214)  LLSKNS-NAIHLQKGLLMNHNTLGDLLD---------------GYSPSPDSASSSPAASS
G3824 Le  (220)  LPFKHS-NGVNLNRALVN-QNTLGEFLEKDMAN----------GCSPSNDTASSSPLCST
G922  At    (4)  LRFQNNPSGVDLQRVLMMSHGSAAEARENDMSNNN--------GYSPSGDSASSLPLPSS
G3812 Gm (1141)  AAAASM----NVQRALHMGQRTFAEWLERDMIN----------AYTLSPDSALS-PLSLG
G3814 Os  (218)  AGCLTP-----VQIIARSSPRSFGELLERELNTRLQLSPDASVVSSLSPHSPAAATAAHP
G3813 Os  (216)  ------------------------------------------AAVAGGDKERRSPESGL
G3827 Os  (222)  ------------------------------------------------------------
G306  At (1142)  ------------------------------------------------------------
G3821 Ps (1143)  ------------------------------------------------------------
G3822 Zm (1144)  ------------------------------------------------------------
G2738 At (1145)  ------------------------------------------------------------
G3009 At (1146)  ------------------------------------------------------------
G307  At (1147)  ------------------------------------------------------------
G308  At (1148)  ------------------------------------------------------------
G309  At (1149)  ------------------------------------------------------------
G3816 Ta (1150)  ------------------------------------------------------------
G3817 Os (1151)  ------------------------------------------------------------
G3818 Gm (1152)  ------------------------------------------------------------
G3010 At (1153)  ------------------------------------------------------------
G3826 Le (1154)  ------------------------------------------------------------
G644  At (1155)  ------------------------------------------------------------
G3823 Os (1156)  ------------------------------------------------------------
G3820 Os (1157)  ------------------------------------------------------------
G1768 At (1158)  ------------------------------------------------------------
G3815 Os (1159)  ------------------------------------------------------------
G3825 Le (1160)  ------------------------------------------------------------
```

Fig. 14N

```
Sequence
Name     (SEQ ID NO.)
G3810 Gm   (212)  TSNSRPRGRFLNALWGLSPKVMVVTEQDCNHNGP-------TLMDRLLEALYSYAALFDC
G3811 Gm   (214)  SALMNSES-FLNALWGLSPKVMVVTEQDFNHNCL-------TMMERLAEALFSYAAYFDC
G3824 Le   (220)  GS-TKMDS-FLNALWGLSPKVMVVTEQDANHNGT-------TLMERLSESLHFYAALFDC
G922  At     (4)  GR---TDS-FLNAIWGLSPKVMVVTEQDSDHNGS-------TLMERLLESLYTYAALFDC
G3812 Gm  (1141)  AS--PKMGIFLNAIRKLQPKLVVITEQESNLNGS-------NLMERVDRALYFYSALFDC
G3814 Os   (218)  TTSTPKLGSFLSAVRSLSPKIMVMTEQEANHNGG-------AFQERFDEALNYYASLFDC
G3813 Os   (216)  SPSTSRADAFLGALWGLSPKVMVVAEQEASHNAA-------GLTERFVEALNYYAALFDC
G3827 Os   (222)  ---------------GLSLKVMVVTEQEVSHNAA-------GLTERFVEALNYYAALFDC
G306  At  (1142)  ---------TLWLLQRLAPKVVTVVEQDLSHAG--------SFLGRFVEAIHYYSALFDS
G3821 Ps  (1143)  ---------TLWLLQRLAPKVVTVVEQDLSNAG--------SFLGRFVEAIHYYSALFDS
G3822 Zm  (1144)  ---------TLWLIQRLAPKVVTMVEQDLSHSG--------SFLARFVEAIHYYSALFDS
G2738 At  (1145)  -----SIEKLLNTVKAIKPSIVTVVEQEANHNGI-------VFLDRFNEALHYYSSLFDS
G3009 At  (1146)  -----SIEKLLATVKAVKPGLVTVVEQEANHNGD-------VFLDRFNEALHYYSSLFDS
G307  At  (1147)  -----GIEKVLGVVKQIKPVIFTVVEQESNHNGP-------VFLDRFTESLHYYSTLFDS
G308  At  (1148)  -----AIDKVLGVVNQIKPEIFTVVEQESNHNSP-------IFLDRFTESLHYYSTLFDS
G309  At  (1149)  -----SIDKFLSTIKSIRPDIMTVVEQEANHNGT-------VFLDRFTESLHYYSSLFDS
G3816 Ta  (1150)  -----ALEKVLGTVRAVRPRIVTVVEQEANHNSG-------TFLDRFTESLHYYSTMFDS
G3817 Os  (1151)  -----ALEKVLGTVHAVRPRIVTVVEQEANHNSG-------SFLDRFTESLHYYSTMFDS
G3818 Gm  (1152)  ---GSGIETVLGWIRSLNPKIISVVEQEANHNQD-------RFLERFTEALHYYSTVFDS
G3010 At  (1153)  ----SPRDAVLKLIRKINPNVFIPAILSGNYNAP-------FFVTRFREALFHYSAVFDM
G3826 Le  (1154)  ----SPRDAVLNLIRRIRPDLFIHGALNGTFNTP-------FFVTRFREALFHFSSLYDM
G644  At  (1155)  ----SCRDTVLNLIGKINPDLFVFGIVNGAYNAP-------FFVTRFREALFHFSSIFDM
G3823 Os  (1156)  ----SARDRVLHMMKRMNPQVFILGVVNGLYSSP-------FFLTRFREVLFHYSSLFDM
G3820 Os  (1157)  ----SARDRVLKIMRMMNPRVFILGIVNGSYSSP-------FFITRFKEVLFHYSSLFDM
G1768 At  (1158)  ----NHRDRLLRMVKSLSPKVVTLVEQECNTNTS-------PFLPRFLETLSYYTAMFES
G3815 Os  (1159)  ----NHRDRILRMVKSLSPRLVTLVEQESNTNTR-------PFFPRYLETLDYYTAMFES
G3825 Le  (1160)  ----NPRDGLIRMIKSLSPKIVTLVEQESNTNTA-------PFLPRFVEALDYYHAMFES
```

Fig. 140

```
Sequence
Name     (SEQ ID NO.)
G3810 Gm    (212)  LEST--------------VSRTSLERLRVEKMLFGEEIKNIIACE-GSERKERHEKLEK
G3811 Gm    (214)  LEST--------------VSRASMDRLKLEKMLFGEEIKNIIACE-GCERKERHEKMDR
G3824 Le    (220)  LEST--------------LPRTSLERLKVEKMLLGEEIRNIIACE-GIERKERHEKLEK
G922  At      (4)  LETK--------------VPRTSQDRIKVEKMLFGEEIKNIISCE-GFERRERHEKLEK
G3812 Gm   (1141)  LDST--------------VMKTSVERQKLESKLLGEQIKNIIACE-GVDRKERHEKLEK
G3814 Os    (218)  LQRS--------------AAAAA-ERARVERVLLGEEIRGVVACE-GAERVERHERARQ
G3813 Os    (216)  LEVG--------------AARGSVERARVERWLLGEEIKNIVACD-GGERRERHERLER
G3827 Os    (222)  LEVG--------------GARGSVERTRVERWLLGEEIKNIVACD-GGERRERHER---
G306  At   (1142)  LGAS--------------YGEESEERHVVEQQLLSKEIRNVLAVG-GPSR-SGEVKFES
G3821 Ps   (1143)  LGSS--------------YGEESEERHVVEQQLLSREIRNVLAVG-GPSR-SGEIKFHN
G3822 Zm   (1144)  LDAS--------------YGEDSPERHVVEQQLLSREIRNVLAVG-GPAR-TGDVKFGS
G2738 At   (1145)  LED---------------SYSLPSQDRVMSEVYLGRQILNVVAAE-GSDRVERHETAAQ
G3009 At   (1146)  LED---------------GVVIPSQDRVMSEVYLGRQILNLVATE-GSDRIERHETLAQ
G307  At   (1147)  LE----------------GVPNSQDKVMSEVYLGKQICNLVACE-GPDRVERHETLSQ
G308  At   (1148)  LE----------------GVPSGQDKVMSEVYLGKQICNVVACD-GPDRVERHETLSQ
G309  At   (1149)  LE----------------GPP-SQDRVMSELFLGRQILNLVACE-GEDRVERHETLNQ
G3816 Ta   (1150)  LEGGSSGGGPSEVSSGAAAAPAAAGTDQVMSEVYLGRQICNVVACE-GAERTERHETLGQ
G3817 Os   (1151)  LEGGSSG--QAELSP--PAAGGGGGTDQVMSEVYLGRQICNVVACE-GAERTERHETLGQ
G3818 Gm   (1152)  LEA---------------CPVEPDKALAEMYLQREICNVVSSE-GPARVERHEPLAK
G3010 At   (1153)  CDSK--------------LAREDEMRLMYEKEFYGREIVNVVACE-GTERVERPETYKQ
G3826 Le   (1154)  FEAT--------------LPREDEDRKLFEEEVFARDAMNVIACE-GTERVERPETYKQ
G644  At   (1155)  LETI--------------VPREDEERMFLEMEVFGREALNVIACE-GWERVERPETYKQ
G3823 Os   (1156)  LDNN--------------VPRNHEARILVEKDLFGNDALNAVACE-GAERIERPESYKQ
G3820 Os   (1157)  IDAN--------------VPRDNEARKMIEGGLFGQEALNIIACE-GAERTERPESYKQ
G1768 At   (1158)  IDVM--------------LPRNHKERINIEQHCMARDVVNIIACE-GAERIERHELLGK
G3815 Os   (1159)  IDVA--------------LPRDDKRRMSAEQHCVARDIVNLIACE-GAERVERHEVFGK
G3825 Le   (1160)  IDVT--------------LLRDMKERINVEQHCLARDIVNVIACE-GKERVERHELLGK
```

Fig. 14P

Sequence
Name    (SEQ ID NO.)

G3810 Gm   (212)  WFQRFDLAGFGNVPLSYFGMVQARRFLQSYGCEG-YRMRDENG--CVLICWEDRPMYSIS
G3811 Gm   (214)  WIQRLDLSGFANVPISYYGMLQGRRFLQTYGCEG-YKMREECG--RVMICWQERSLFSIT
G3824 Le   (220)  WFQRFDTSGFGNVPLSYYAMLQARRLLQSYSCEG-YKIKEDNG--CVVICWQDRPLFSVS
G922  At    (4)   WSQRIDLAGFGNVPLSYYAMLQARRLLQGCGFDG-YRIKEESG--CAVICWQDRPLYSVS
G3812 Gm   (1141) WIRRLEMAGFEKVPLSYNGRLEAKNLLQRYSNK--YKFREEND--CLLVCWSDRPLFSRA
G3814 Os   (218)  WAARMEAAGMERVGLSYSGAMEARKLLQSCGWAGPYEVRHDAGGHGFFFCWHKRPLYAVT
G3813 Os   (216)  WARRLEGAGFGRVPLSYYALLQARRVAQGLGCDG-FKVREEKG--NFFLCWQDRALFSVS
G3827 Os   (222)  ----LEGAGFGRVPLSYYALLQARRVAQGLGCDG-FKVREEKG--NFFLCWQDRALFSVS
G306  At   (1142) WREKMQQCGFKGISLAGNAATQATLLLGMFPSDG-YTLVDDNG--TLKLGWKDLSLLTAS
G3821 Ps   (1143) WREKLQQCGFRGVSLAGNAATQASLLLGMFPSEG-YTLVEDNG--ILKLGWKDLCLLTAS
G3822 Zm   (1144) WREKLAQSGFRAASLAGSAAAQASLLLGMFPSDG-YTLVEENG--ALKLGWKDLCLLTAS
G2738 At   (1145) WRIRMKSAGFDPIHLGSSAFKQASMLLSLYATGDGYRVEENDG--CLMIGWQTRPLITTS
G3009 At   (1146) WRKRMGSAGFDPVNLGSDAFKQASLLLALSGGGDGYRVEENDG--SLMLAWQTKPLIAAS
G307  At   (1147) WGNRFGSSGLAPAHLGSNAFKQASMLLSVFNSGQGYRVEESNG--CLMLGWHTRPLITTS
G308  At   (1148) WRNRFGSAGFAAAHIGSNAFKQASMLLALFNGGEGYRVEESDG--CLMLGWHTRPLIATS
G309  At   (1149) WRNRFGLGGFKPVSIGSNAYKQASMLLALYAGADGYNVEENEG--CLLLGWQTRPLIATS
G3816 Ta   (1150) WRNRLGNAGFETVHLGSNAYKQASTLLALFAGGDGYKVEEKEG--CLTLGWHTRPLIATS
G3817 Os   (1151) WRNRLGRAGFEPVHLGSNAYKQASTLLALFAGGDGYRVEEKEG--CLTLGWHTRPLIATS
G3818 Gm   (1152) WRERLEKAGFKPLHLGSNAYKQASMLLTLFS-AEGYSVEENQG--CLTLGWHSRPLIAAS
G3010 At   (1153) WQARLIRAGFRQLPLEKELMQNLKLKIENGYD-KNFDVDQNGN--WLLQGWKGRIVYASS
G3826 Le   (1154) WQLRCVRAGFKQVPLDQEIVKIVRNKVRSEYH-RDFSVDEDGH--WMLQGWKGRVIYALS
G644  At   (1155) WHVRAMRSGLVQVPFDPSIMKTSLHKVHTFYH-KDFVIDQDNR--WLLQGWKGRTVMALS
G3823 Os   (1156) WQMRILRAGFKQRPVNQAILNRSVHYKE-FYH-EDFVIDEDSG--WLLQGWKGRIIQALS
G3820 Os   (1157) WQARCLKAGFKQLPVDPATLKEIINMKKGIYH-EDFVADEDGA--WLLQGWKGRVIYAIS
G1768 At   (1158) WKSRFSMAGFEPYPLS-SIISATIRALLRD-YSNGYAIEERDG--ALYLGWMDRILVSSC
G3815 Os   (1159) WKARLTMAGFRPYPLS-SVVNSTIKTLLHT-YNSFYRLEERDG--VLYLGWKNRVLVVSS
G3825 Le   (1160) WKSRFMMAGFQQYPLS-SYVNSVIKDLMKR-YSEHYTLVEKDG--AMLLGWKERNLVSAS

Fig. 14Q

```
Sequence
Name     (SEQ ID NO.)
G3810 Gm  (212)  AWRSRK----------------------------------------------------
G3811 Gm  (214)  AWRPRK----------------------------------------------------
G3824 Le  (220)  SWRCRK----------------------------------------------------
G922  At   (4)   AWRCRK----------------------------------------------------
G3812 Gm (1141)  EF--------------------------------------------------------
G3814 Os  (218)  AWRPAASRRGHTLH------GRRSEGTRESVPWPPR----------------------
G3813 Os  (216)  AWRGRRFD--------------------------------------------------
G3827 Os  (222)  AWRGRRFAALLPLPPSTPLPCSRVIATLLSSPPPPCSPLHPYCPERRERMKGEKKGKRE-
G306  At (1142)  AWTPRS----------------------------------------------------
G3821 Ps (1143)  AWRPPYHTNTIIPHHN------------------------------------------
G3822 Zm (1144)  AWRPIQVPPCR-----------------------------------------------
G2738 At (1145)  AWKLA-----------------------------------------------------
G3009 At (1146)  AWKLAAELRR------------------------------------------------
G307  At (1147)  AWKLSTAAH-------------------------------------------------
G308  At (1148)  AWKLSTN---------------------------------------------------
G309  At (1149)  AWRINRVE--------------------------------------------------
G3816 Ta (1150)  AWRLAGP---------------------------------------------------
G3817 Os (1151)  AWRVAAA---------------------------------------------------
G3818 Gm (1152)  AWQAAPMQDRETLRFEQ-----------------------------------------
G3010 At (1153)  LWVP----------------SSS-----------------------------------
G3826 Le (1154)  CWKP----------------TKQSVKLV------------------------------
G644  At (1155)  VWKP----------------ESKA----------------------------------
G3823 Os (1156)  TWKV----------------ET------------------------------------
G3820 Os (1157)  TWKP----------------NESYLDQ-------------------------------
G1768 At (1158)  AWK-------------------------------------------------------
G3815 Os (1159)  AWC-------------------------------------------------------
G3825 Le (1160)  AWF-------------------------------------------------------
```

Fig. 14R

| Sequence Name | (SEQ ID NO.) | 260 | 270 | 280 | 290 | 300 |
|---|---|---|---|---|---|---|
| G3728 | (1161) | WRKYGKKAVKNSPNPRNYYRCSSEGCGVKKRVERDRDDPRYV |
| G3804 | (1162) | WRKYGKKAVKNSPNPRNYYRCSSEGCGVKKRVERDRDDPRYV |
| G3802 | (1163) | WRKYGKKAVKNSPNPRNYYRCSSEGCGVKKRVERDRDDPRYV |
| G3727 | (1164) | WRKYGKKAVKSSPNPRNYYRCSSEGCGVKKRVERDRDDPRYV |
| G3721 | (1165) | WRKYGKKAVKNSPNPRNYYRCSTEGCNVKKRVERDREDHRYV |
| G3730 | (1166) | WRKYGKKAVKSSPNPRNYYRCSAAGCGVKKRVERDGDDPRYV |
| G3719 | (1167) | WRKYGKKAVKSSPNPRNYYRCSTEGSGVKKRVERDSDDPRYV |
| G3725 | (1168) | WRKYGKKSVKNSPNPRNYYRCSTEGCNVKKRVERDKNDPRYV |
| G3722 | (1169) | WRKYGKKSVKNSPNPRNYYRCSTEGCNVKKRVERDRDDPRYV |
| G3733 | (1170) | WRKYGKKSVKNSPNPRNYYRCSTEGCSVKKRVERDRDDPAYV |
| G3726 | (1171) | WRKYGKKSVKNSPNPRNYYRCSTEGCNVKKRVERDKDDPSYV |
| G3720 | (1172) | WRKYGKKSVKNSPNPRNYYRCSTEGCNVKKRVERDKDDPSYV |
| G3729 | (1173) | WRKYGKKMVKNSPNPRNYYRCSSEGCRVKKRVERARDDARFV |
| G3797 | (1174) | WRKYGKKMVKNSPNPRNYYRCSAAGCSVKKRVERDVEDARYV |
| G3795 | (1175) | WRKYGKKMVKNSPNPRNYYRCSVEGCPVKKRVERDKEDSRYV |
| G1275 | (1176) | WRKYGKKMVKNSPHPRNYYKCSVDGCPVKKRVERDRDDPSFV |
| G1274 | (1177) | WRKYGKKSVKNNINKRNYYKCSSEGCSVKKRVERDGDDAAYV |
| G3732 | (1178) | WRKYGKKMVKNSSNPRNYYKCSSGGCNVKKRVERDNEDSSYV |
| G3731 | (1179) | CRKYGKKMVKNNPNPRNYYKCSSGGCNVKKRVERDNKDSSYV |
| G3724 | (1180) | WRKYGKKSVKSSPNLRNYYKCSSGGCSVKKRVERDRDDYSYV |
| G3723 | (1181) | WRKYGKKTVKSSPNPRNYYKCSGEGCDVKKRVERDRDDSNYV |
| G3803 | (1182) | WRKYGKKTVKNNPNPRNYYKCSGEGCNVKKRVERDRDDSNYV |
| G1758 | (1183) | WRKYGKKPITGSPFPRHYHKCSSPDCNVKKKIERDTNNPDYI |
| G194 | (1184) | WRKYGQKAVKNSPFPRSYYRCTTASCNVKKRVERSFRDPSTV |
| G2517 | (1185) | WRKYGQKPVKDSPFPRNYYRCTTTWCDVKKRVERSFSDPSSV |
| G179 | (1186) | WRKYGQKAVKNNPFPRSYYKCTEEGCRVKKQVQRQWGDEGVV |
| G2688 | (1187) | WRKYGQKAVKNNKFPRSYYRCTYGGCNVKKQVQRLTVDQEVV |
| G1956 | (1188) | WRKYGQKVVKNTQHPRSYYRCTQDKCRVKKRVERLADDPRMV |
| G181 | (1189) | WRKYGQKSVKHNAHPRSYYRCTYHTCNVKKQVQRLAKDPNVV |
| G1931 | (1190) | WRKYGQKSVKNNAHPRSYYRCTYHTCNVKKQVQRLAKDPNVV |
| G1012 | (1191) | WRKYGQKSVKNSLYPRSYYRCTQHMCNVKKQVQRLSKETSIV |
| G1420 | (1192) | WRKYGQKAVKNSPYPRSYYRCTTVGCVKKRVERSSDDPSIV |
| G2290 | (1193) | WRKYGQKAVKNSPFPRSYYRCTNSRCTVKKRVERSSDDPSIV |
| G2575 | (1194) | WRKYGQKAVKNSPYPRSYYRCTTQKCNVKKRVERSFQDPSIV |
| G195 | (1195) | WRKYGQKAVKNSPYPRSYYRCTTQKCNVKKRVERSYQDPTVV |
| G187 | (1196) | WRKYGQKAVKNSPYPRSYYRCTTQKCNVKKRVERSFQDPTVV |
| G1013 | (1197) | WRKYGQKSIKNSPNPRSYYKCTNPICNAKKQVERSIDESNTY |

Fig. 16

| Sequence Name (SEQ ID NO.) | |
|---|---|
| |               10                    20                    30 |
| G3809 (1012) | M A V E G F E E A I K C L E N L K L E S G E A S L E Q R V R |
| pG3807 (1222) | |
| pG521 (1223) | |
| pG3041 (690) | |
| pG3832 (1224) | |
| pG515 (20) | |
| pG2053 (10) | |
| pG516 (22) | |
| pG517 (24) | |
| pG513 (1225) | |
| pG960 (1226) | |
| pG3834 (1227) | |
| pG1455 (1228) |                                                     M |
| pG3805 (1229) | |
| pG958 (520) | |
| pG1924 (1230) | |
| pG518 (612) | |
| pG3808 (1231) |                   M R L A R Q Q Q Q V V V A A |
| pG3833 (1232) | |
| pG523 (1233) | |
| pG514 (1234) | |
| pG3806 (1235) | |
| pG526 (1236) | |
| pG1454 (954) | |

Fig. 18A

| Sequence Name (SEQ ID NO.) | 40 | 50 | 60 |
|---|---|---|---|
| G3809 (1012) | P G I N S I L P A A A C G D H H T A A G A G | L P P G F R F H | |
| pG3807 (1222) | M A K T S | L P P G F R F H | |
| pG521 (1223) | M G K T N | L A P G F R F H | |
| pG3041 (690) | M G R G S V T S | L A P G F R F H | |
| pG3832 (1224) | M V | G F R F R | |
| pG515 (20) | M E T P V | G L R F C | |
| pG2053 (10) | M E N P V | G L R F R | |
| pG516 (22) | M A N P V | G F R F R | |
| pG517 (24) | M M N P V | G F R F R | |
| pG513 (1225) | M K E D M E V L S L A S | L P V G F R F S | |
| pG960 (1226) | M G A V S M E S | L P L G F R F R | |
| pG3834 (1227) | M E S | L P L G F R F R | |
| pG1455 (1228) | N Q I K N K T L P E M T T E Q A L L S M E A | L P L G F R F R | |
| pG3805 (1229) | M A P V S | L P P G F R F H | |
| pG958 (520) | M A P V S M | P P G F R F H | |
| pG1924 (1230) | M A P V G | L P P G F R F H | |
| pG518 (612) | M A P V S | L P P G F R F H | |
| pG3808 (1231) | T M E H D V H H H R Q M M Q Q Q Q Q E M D | L P P G F R F H | |
| pG3833 (1232) | M E N V S V L L C N K E K D Q M D | L P P G F R F H | |
| pG523 (1233) | M E T F G V F H K E D D - E Q M D | L P P G F R F H | |
| pG514 (1234) | M E T F C G F Q K E E - - E Q M D | L P P G F R F H | |
| pG3806 (1235) | M S E S E V S V I N Q L E E E E T R L E | L P P G F R F H | |
| pG526 (1236) | M A V V V E E G V V L N H G G E E - - L V D | L P P G F R F H | |
| pG1454 (954) | M E S T D S S G G P P P P Q P N | L P P G F R F H | |
| | | L P P G F R F H | |

Fig. 18B

| Sequence Name (SEQ ID NO.) | 70 | 80 | 90 |
|---|---|---|---|
| G3809 (1012)  | P T D E E L L L H Y L G K R A | A - - - - - A A P C P A | P V I |
| pG3807 (1222) | P T D V E L T V Y Y L K R K L | L - - - - - G K H L R C N | A V |
| pG521 (1223)  | P T D V E L V R Y Y L K R K V | M - - - - - G K K F Q V D | A I |
| pG3041 (690)  | P T D E E L V R Y Y L K R K I | C - - - - - N K P F K F D | A I |
| pG3832 (1224) | P T D V E L V E H Y L R P K N | N G G G S T T S S Q V D Q | V I |
| pG515 (20)    | P T D E E I V V D Y L W P K N | S - - - D R D T S H V D R | F I |
| pG2053 (10)   | P T D K E I V V D Y L R P K N | S - - - D R D T S H V D R | V I |
| pG516 (22)    | P T D G E I V D I Y L R P K N | L - - - E S N T S H V D E | V I |
| pG517 (24)    | P N D E E I V D H Y L R P K N | L - - - D S D T S H V D E | V I |
| pG513 (1225)  | P T D E E L V R Y Y L R L K I | N - - - - - G H D N D V R | V I |
| pG960 (1226)  | P T D E E L V N H Y L R L K I | N - - - - - G R H S D V R | V I |
| pG3834 (1227) | P T D E E L I N H Y L R L K I | N - - - - - G R D L E V R | V I |
| pG1455 (1228) | P T D E E L I N H Y L R L K I | N - - - - - G R D L E V R | V I |
| pG3805 (1229) | P T D E E L I I Y Y L K R K I | N - - - - - G R Q I E L E | I I |
| pG958 (520)   | P T D E E L V I Y Y L K R K I | N - - - - - G R T I E L E | I I |
| pG1924 (1230) | P T D E E L V N Y Y L K R K I | N - - - - - G Q E I E L D | I I |
| pG518 (612)   | P T D E E L I T Y Y L K R K I | N - - - - - G Q E I E L E | I I |
| pG3808 (1231) | P T D E E L I T H Y L L R K A | A D - - - - P A G F A A R | A V |
| pG3833 (1232) | P T D E E L I S H Y L Y R K V | T - - - - - D T N F S A R | A I |
| pG523 (1233)  | P T D E E L I T H Y L H K K V | L - - - - - D L G F S A K | A I |
| pG514 (1234)  | P T D E E L I T H Y L H N K V | L - - - - - D T S F S A K | A I |
| pG3806 (1235) | P T D E E V V T H Y L T R K A | Q - - - - - D R S F S C V | V I |
| pG526 (1236)  | P T D E E I I T C Y L K E K V | L - - - - - N S R F T A V | A M |
| pG1454 (954)  | P T D E E L V V H Y L K R K A | A - - - - - S A P L P V A | I I |
|               | P T D E E L V   H Y L . . K . |                           | . I |

Fig. 18C

| Sequence Name (SEQ ID NO.) | 100 | 110 | 120 |
|---|---|---|---|
| G3809 (1012)  | A E V D I Y K Y N P W E L P A M A | - V F G E S D G | E W Y F F |
| pG3807 (1222) | S E L D L Y K F A P W D L P E K S | - S L Q S K D R | E W Y F F |
| pG521 (1223)  | A E V D I Y K F E P P D L P D K S | - C L G T G D L | K W Y F F |
| pG3041 (690)  | S V T D V Y K S E P W D L P D K S | - R L K S R D L | E W Y F F |
| pG3832 (1224) | N T V D I C N L D P W E L P R K S | S R I A S S D Q | V W Y F F |
| pG515 (20)    | N T V P V C R L D P W E L P C Q S | - R I K L K D V A | W C F F |
| pG2053 (10)   | S T V T I R S F D P W E L P C Q S | - R I K L K D E S | W C F F |
| pG516 (22)    | S T V D I C S F D P W D L P S H S | - R M K T R D Q | V W Y F F |
| pG517 (24)    | S T V D I C S F E P W D L P S K S | - M I K S R D G | V W Y F F |
| pG513 (1225)  | R E I D I C K W E P W D L P D F S | - V V K T T D S E | W L F F |
| pG960 (1226)  | P D I D V C K W E P W D L P A L S | - V I K T D D P | E W F F F |
| pG3834 (1227) | P E I D V C K W E P W D L P G L S | - V I K T D D Q | E W F F F |
| pG1455 (1228) | P E I D V C K W E P W D L P G L S | - V I K T D D Q | E W F F F |
| pG3805 (1229) | P E V D L Y K C E P W D L P E K S | - F L P S K D L | E W Y F F |
| pG958 (520)   | P E I D L Y K C E P W D L P G K S | - L L P S K D L | E W F F F |
| pG1924 (1230) | P E V D L Y K C E P W D L A E K S | - F L P S R D P | E W Y F F |
| pG518 (612)   | P E V D L Y K C E P W D L P G K S | - L I P S K D Q | E W F F F |
| pG3808 (1231) | G E A D L N K C E P W D L P S R A | - T M G E K - - | E W Y F F |
| pG3833 (1232) | G E V D L N R S E P W D L P W K A | - K M G E K - - | E W Y F F |
| pG523 (1233)  | G E V D L N K A E P W E L P Y K A | - K I G E K - - | E W Y F F |
| pG514 (1234)  | G E V D L N K S E P W E L P W M A | - K M G E K - - | E W Y F F |
| pG3806 (1235) | A D V N L N N C E P W D L P S K A | - K M G E K - - | E W F F F |
| pG526 (1236)  | G E A D L N K C E P W D L P K R A | - K M G E K - - | E F Y F F |
| pG1454 (954)  | A E V D L Y K F D P W E L P A K A | - S F G E Q - - | E W Y F F |
|               | E V D L K E P W D L P K S . . K D | E W Y F F | |

Fig. 18D

| Sequence Name (SEQ ID NO.) | 130 | | | | | | | | | | 140 | | | | | | | | | | 150 |
|---|---|---|---|---|---|---|---|---|---|---|---|---|---|---|---|---|---|---|---|---|---|
| G3809 (1012)  | S | P | R | D | R | K | Y | P | N | G | V | R | P | N | R | A | A | G | S | G | Y W K A T G T D K P |
| pG3807 (1222) | C | P | R | D | R | K | Y | S | S | G | S | R | T | N | R | S | T | E | A | G | Y W K A T G K D R P |
| pG521 (1223)  | C | P | R | E | K | K | Y | P | K | G | G | K | A | N | R | S | T | E | C | G | Y W K T T G R D R D |
| pG3041 (690)  | S | M | L | D | K | K | Y | R | N | G | S | K | T | N | R | A | T | E | M | G | Y W K T T G K D R E |
| pG3832 (1224) | G | R | K | E | S | R | Y | N | R | G | E | R | Q | K | R | K | T | K | S | G | Y W K K T G N T L P |
| pG515 (20)    | R | P | K | E | N | K | Y | G | R | G | D | Q | Q | M | R | K | T | K | S | G | F W K S T G R P K P |
| pG2053 (10)   | S | P | K | E | N | K | Y | G | R | G | D | Q | Q | I | R | K | T | K | S | G | Y W K I T G K P K P |
| pG516 (22)    | G | R | K | E | N | K | Y | G | K | G | D | R | Q | I | R | K | T | K | S | G | F W K K T G V T M D |
| pG517 (24)    | S | V | K | E | M | K | Y | N | R | G | D | Q | Q | R | R | R | T | N | S | G | F W K K T G K T M T |
| pG513 (1225)  | C | P | L | D | R | K | Y | P | S | G | S | R | M | N | R | A | T | V | A | G | Y W K A T G K D R K |
| pG960 (1226)  | C | P | R | D | R | K | Y | P | N | G | H | R | S | N | R | A | T | D | S | G | Y W K A T G K D R S |
| pG3834 (1227) | C | P | R | D | R | K | Y | P | S | G | H | R | S | N | R | A | T | D | I | G | Y W K A T G K D R T |
| pG1455 (1228) | C | P | R | D | R | K | Y | P | S | G | H | R | S | N | R | A | T | D | I | G | Y W K A T G K D R T |
| pG3805 (1229) | S | P | R | D | R | K | Y | P | N | G | S | R | T | N | R | A | T | K | A | G | Y W K A T G K D R K |
| pG958 (520)   | S | P | R | D | R | K | Y | P | N | G | S | R | T | N | R | A | T | K | A | G | Y W K A T G K D R K |
| pG1924 (1230) | G | P | R | D | R | K | Y | P | N | G | F | R | T | N | R | A | T | R | G | G | Y W K S T G K D R R |
| pG518 (612)   | S | P | R | D | R | K | Y | P | N | G | S | R | T | N | R | A | T | K | G | G | Y W K A T G K D R R |
| pG3808 (1231) | C | V | K | D | R | K | Y | P | T | G | L | R | T | N | R | A | T | E | S | G | Y W K A T G K D R E |
| pG3833 (1232) | C | V | R | D | R | K | Y | P | T | G | L | R | T | N | R | A | T | E | S | G | Y W K A T G K D K E |
| pG523 (1233)  | C | V | R | D | R | K | Y | P | T | G | L | R | T | N | R | A | T | Q | A | G | Y W K A T G K D K E |
| pG514 (1234)  | C | V | R | D | R | K | Y | P | T | G | L | R | T | N | R | A | T | E | A | G | Y W K A T G K D K E |
| pG3806 (1235) | C | H | K | D | R | K | Y | P | T | G | M | R | T | N | R | A | T | A | S | G | Y W K A T G K D K E |
| pG526 (1236)  | C | Q | R | D | R | K | Y | P | T | G | M | R | T | N | R | A | T | E | S | G | Y W K A T G K D K E |
| pG1454 (954)  | S | P | R | D | R | K | Y | P | N | G | A | R | P | N | R | A | A | T | S | G | Y W K A T G T D K P |
|               | C | P | R | D | R | K | Y | P |   | G |   | R | T | N | R | A | T |   | S | G | Y W K A T G K D R   |

Fig. 18E

| Sequence Name (SEQ ID NO.) | 160 | | | | | | | | | | 170 | | | | | | | | | | 180 | | |
|---|---|---|---|---|---|---|---|---|---|---|---|---|---|---|---|---|---|---|---|---|---|---|---|
| G3809 (1012) | I | S | I | S | E | T | Q | Q | T | V | L | L | G | V | K | K | A | L | V | F | Y | R | G | R | P | P | K | G | T | K |
| pG3807 (1222) | V | I | Y | N | - | - | - | - | S | Q | T | V | G | M | K | R | T | L | V | F | H | L | G | K | P | P | R | G | D | R |
| pG521 (1223) | V | S | Y | N | - | - | - | - | D | E | V | T | G | K | I | R | T | L | I | Y | H | Y | G | K | I | P | R | G | D | R |
| pG3041 (690) | I | L | N | G | - | - | - | - | S | K | V | V | G | M | K | K | T | L | V | Y | H | K | G | R | A | P | R | G | E | R |
| pG3832 (1224) | I | T | R | K | R | - | G | N | H | E | T | I | G | E | K | R | V | L | M | F | Y | M | S | G | S | R | - | - | - | - |
| pG515 (20) | I | M | R | - | - | - | - | N | R | Q | Q | I | G | E | K | K | I | L | M | F | Y | T | S | K | E | S | - | - | - | K |
| pG2053 (10) | I | L | R | - | - | - | - | N | R | Q | E | I | G | E | K | K | V | L | M | F | Y | M | S | K | E | L | G | G | S | K |
| pG516 (22) | I | M | R | K | T | - | G | D | R | E | K | I | G | E | K | R | V | L | V | F | K | N | H | G | G | S | - | - | - | K |
| pG517 (24) | V | M | R | K | R | - | G | N | R | E | K | I | G | E | K | R | V | L | V | F | K | N | R | D | G | S | - | - | - | K |
| pG513 (1225) | I | K | S | G | - | - | - | K | T | K | I | I | G | V | K | R | T | L | V | F | Y | T | G | R | A | P | K | G | T | R |
| pG960 (1226) | I | K | S | - | - | - | - | K | K | T | L | I | G | M | K | K | T | L | V | F | Y | R | G | R | A | P | K | G | E | R |
| pG3834 (1227) | I | K | S | - | - | - | - | K | K | M | I | I | G | M | K | K | T | L | V | F | Y | R | G | R | A | P | I | G | E | R |
| pG1455 (1228) | I | K | S | - | - | - | - | K | K | M | I | I | G | M | K | K | T | L | V | F | Y | R | G | R | A | P | R | G | E | R |
| pG3805 (1229) | V | N | S | Q | - | - | - | R | - | R | A | V | G | M | K | K | T | L | V | Y | Y | R | G | R | A | P | H | G | S | R |
| pG958 (520) | V | T | S | H | - | - | - | S | - | R | M | V | G | T | K | K | T | L | V | Y | Y | R | G | R | A | P | H | G | S | R |
| pG1924 (1230) | V | T | S | Q | - | - | - | S | - | R | A | I | G | M | K | K | T | L | V | Y | Y | K | G | R | A | P | Q | G | I | R |
| pG518 (612) | V | S | W | R | - | - | - | D | - | R | A | I | G | T | K | K | T | L | V | Y | Y | R | G | R | A | P | H | G | I | R |
| pG3808 (1231) | I | F | R | G | - | - | - | K | - | A | L | V | G | M | K | K | T | L | V | F | Y | T | G | R | A | P | R | G | G | K |
| pG3833 (1232) | I | F | R | G | - | - | - | K | - | S | L | V | G | M | K | K | T | L | V | F | Y | K | G | R | A | P | K | G | E | K |
| pG523 (1233) | I | F | R | G | - | - | - | K | - | S | L | V | G | M | K | K | T | L | V | F | Y | R | G | R | A | P | K | G | Q | K |
| pG514 (1234) | I | Y | R | G | - | - | - | K | - | S | L | V | G | M | K | K | T | L | V | F | Y | R | G | R | A | P | K | G | Q | K |
| pG3806 (1235) | I | F | R | G | - | - | - | R | G | L | L | V | G | M | K | K | T | L | V | F | Y | M | G | R | A | P | R | G | E | K |
| pG526 (1236) | I | F | K | G | - | - | - | K | G | C | L | V | G | M | K | K | T | L | V | F | Y | R | G | R | A | P | K | G | E | K |
| pG1454 (954) | V | L | A | S | D | - | - | G | N | Q | K | V | G | V | K | K | A | L | V | F | Y | S | G | K | P | P | K | G | V | K |
|  | I |   |   |   |   |   |   |   |   |   | . | . | G | M | K | K | T | L | V | F | Y | . | G | R | A | P | . | G |   | K |

Fig. 18F

| Sequence Name (SEQ ID NO.) | | | 190 | | | | | | | | | | 200 | | | | | | | | | 210 | | | |
|---|---|---|---|---|---|---|---|---|---|---|---|---|---|---|---|---|---|---|---|---|---|---|---|---|---|
| G3809 (1012) | T | S | W | I | M | H | E | Y | R | L | A | N | A | A | A | S | S | S | S | - | - | - | - | - | - |
| pG3807 (1222) | T | D | W | V | M | Y | E | Y | R | L | E | D | K | E | L | S | A | S | G | V | K | - | - | L | - |
| pG521 (1223) | T | D | W | V | I | H | E | Y | R | L | E | D | K | V | L | A | Q | K | N | V | P | - | - | Q | - |
| pG3041 (690) | T | N | W | V | M | H | E | Y | R | L | V | D | Q | D | L | D | K | T | G | V | H | - | - | Q | - |
| pG3832 (1224) | S | N | W | V | M | H | E | Y | H | A | S | C | L | S | P | N | D | - | - | - | - | - | - | - | - |
| pG515 (20) | S | D | W | V | I | H | E | Y | H | G | F | S | H | N | Q | M | M | M | T | - | Y | - | - | - | - |
| pG2053 (10) | S | D | W | V | M | H | E | Y | H | A | F | S | P | T | Q | M | M | M | T | - | Y | - | - | - | - |
| pG516 (22) | S | D | W | A | M | H | E | Y | H | A | T | F | S | S | P | N | Q | - | - | - | - | - | - | - | - |
| pG517 (24) | T | D | W | V | M | H | E | Y | H | A | T | S | L | F | P | N | Q | M | M | T | Y | - | - | - | - |
| pG513 (1225) | T | C | W | I | M | H | E | Y | R | A | T | E | K | D | L | D | G | T | K | S | G | - | - | Q | - |
| pG960 (1226) | T | N | W | I | M | H | E | Y | R | P | T | L | K | D | L | D | G | T | S | P | G | - | - | Q | - |
| pG3834 (1227) | T | N | W | I | M | H | E | Y | R | A | T | D | K | D | L | D | G | T | G | P | G | - | - | Q | - |
| pG1455 (1228) | T | N | W | I | M | H | E | Y | R | A | T | D | K | E | L | D | G | T | G | P | G | - | - | Q | - |
| pG3805 (1229) | T | D | W | V | M | H | E | Y | R | L | D | E | R | E | C | E | - | T | D | T | G | - | L | Q | - |
| pG958 (520) | T | D | W | V | M | H | E | Y | R | L | E | E | Q | E | C | D | - | S | K | S | G | - | I | Q | - |
| pG1924 (1230) | T | D | W | V | M | H | E | Y | R | L | D | D | K | D | C | D | - | D | P | S | S | - | L | Q | - |
| pG518 (612) | T | G | W | V | M | H | E | Y | R | L | D | E | S | E | C | E | - | P | S | A | F | G | M | Q | - |
| pG3808 (1231) | T | G | W | V | M | H | E | Y | R | I | H | G | K | H | A | A | A | N | S | K | Q | - | - | D | - |
| pG3833 (1232) | T | D | W | V | M | H | E | Y | R | L | D | G | K | F | S | F | H | T | L | P | K | T | A | K | - |
| pG523 (1233) | T | N | W | V | M | H | E | Y | R | L | D | G | K | L | S | A | H | N | L | P | K | T | A | K | - |
| pG514 (1234) | T | N | W | V | M | H | E | Y | R | L | E | G | K | F | S | A | H | N | L | P | K | T | A | K | - |
| pG3806 (1235) | T | P | W | V | M | H | E | Y | R | L | D | G | K | L | P | P | - | N | L | P | R | S | A | K | - |
| pG526 (1236) | T | N | W | V | M | H | E | Y | R | L | E | G | K | Y | S | Y | Y | N | L | P | K | S | A | R | - |
| pG1454 (954) | S | D | W | I | M | H | E | Y | R | L | I | E | N | K | P | N | N | R | P | P | G | C | D | F | G N K K N S |
| | T | | W | V | M | H | E | Y | R | L | | | K | | | | | | | | | | | | |

Fig 18G

| Sequence Name (SEQ ID NO.) | 220 | 230 | 240 |
|---|---|---|---|
| G3809 (1012)   | - - - - - - Y T S N M K Q L A S - - - - - - - - - - |
| pG3807 (1222)  | - - - D A C V L C K I F Q K S G P - - - - - - - - - |
| pG521 (1223)   | - - - D T Y V L C V L F K K N G - - - - - - - - - - |
| pG3041 (690)   | - - - D A F V L C R I F Q K S G S - - - - - - - - - |
| pG3832 (1224)  | - - - - - - - - - - - - - - - - - - - - - - - - - - |
| pG515 (20)     | - - - - - - T L C K V M F N G G M - - - - - - - - - |
| pG2053 (10)    | - - - - - - T I C K V M F K G D V - - - - - - - - - |
| pG516 (22)     | - - - - - - - - - - - - - G E R - - - - - - - - - - |
| pG517 (24)     | - - - - - - T V C K V E F K G E E - - - - - - - - - |
| pG513 (1225)   | - - - N P F V V C K L F K K Q D I V - - - - - - - - |
| pG960 (1226)   | - - - S P Y V L C R L F H K P D D - - - - - - - - - |
| pG3834 (1227)  | - - - S P Y V L C R L F H K P S D - - - - - - - - - |
| pG1455 (1228)  | - - - N P Y V L C R L F H K P S D S - - - - - - - - |
| pG3805 (1229)  | - - - D A Y A L C R V F K K T A P G P K I I E H Y G V V H H |
| pG958 (520)    | - - - D A Y A L C R V F K K S A - - - - L A N K I E E Q H H |
| pG1924 (1230)  | - - - D S Y A L C R V F K K - - - - - - - - - - - - |
| pG518 (612)    | - - - D A Y A L C R V F K K I V - - - - I E A K P R D Q H Q |
| pG3808 (1231)  | - - - Q E W V L C R V F K K S - - - - - - - - - - - |
| pG3833 (1232)  | - - - N E W V I C R V F Q K S S - - - - - - - - - - |
| pG523 (1233)   | - - - N E W V I C R V F H K T A - - - - - - - - - - |
| pG514 (1234)   | - - - - - K W V C R V F Q K S A - - - - - - - - - - |
| pG3806 (1235)  | - - - E E W A V C R V F N K D - - - - - - - - - - - |
| pG526 (1236)   | - - - D E W V V C R V F H K N N - - - - - - - - - - |
| pG1454 (954)   | L R L D D W V L C R I Y K K N N - - - - - - - - - - |
|                | . V L C R V F . K |

Fig. 18H

| Sequence Name (SEQ ID NO.) | 250 | 260 | 270 |
|---|---|---|---|
| G3809 (1012)  | - - - - - - - - - - - - - S S S S S S S S A S M R | L D E | W V |
| pG3807 (1222) | - - - - - - - - - - - G P K I G E Q Y G A P F N E | D D | W N |
| pG521 (1223)  | - - - - - - - - - - L G P R H G S Q Y G A P F K E | E D | W S |
| pG3041 (690)  | - - - - - - - - - - - G P K N G E Q Y G A P F V E | E E | W E |
| pG3832 (1224) | - - - - - - - - - - - - - - - - - - - - - - - - - | - - - | - - |
| pG515 (20)    | - - - - - - - - - - - - - - R E K S S S S P S S S G | V S G | I E |
| pG2053 (10)   | - - - - - - - - - - - - - - - R E I S S S S - - A S Y G | S E | I E |
| pG516 (22)    | - - - - - - - - - - - - - - - - R E F S - V A - - - - T G | S G | I K |
| pG517 (24)    | - - - - - - - - - - - - - - - T E I S S S S - - - - T G | S E | I E |
| pG513 (1225)  | - - N G A A E P E E S K S C E V E P A V S S P T V | V D E | V E |
| pG960 (1226)  | - - - - - - R V N G V K S D E A A F T A S N K Y S P | D D | T S |
| pG3834 (1227) | - - - - V A N C D E V E N V N A T P - T T T R C S R | E D | N S |
| pG1455 (1228) | - - C D P A H C E E I E K V N F T P T T T T R C S P | D D | T S |
| pG3805 (1229) | H V E Q P Q W M T S S I D R S P T L D V S C D G R | G D D | F E |
| pG958 (520)   | G T K K N K G T T N S E Q S T S S T C L Y S D G M Y | E N | L E |
| pG1924 (1230) | - - - - - - - - - - - - - - - - - N G - - - - - I C S | E L | E |
| pG518 (612)   | Q Q H Q P Y V H T - - - - S S N I S G S S S F D V C S | D L | E |
| pG3808 (1231) | - - - - - - - - - - - - L E L A P A A A A A V G R R | G A G | A G |
| pG3833 (1232) | - - - - - - - - - - - - - G V K R T H I S G M M M | L D S | Y G |
| pG523 (1233)  | - - - - - - - - - - - - - G G K K I P I S T L I R | I G S | Y G |
| pG514 (1234)  | - - - - - - - - - - - - - G G K K I P I S S L I R | I G S | L G |
| pG3806 (1235) | - - - - - - - - - - - - - - - - L A A K I A Q M P P P | P F P |
| pG526 (1236)  | - - - - - - - - - - - - - - P S T T T Q P M T R I P | V E D | F T |
| pG1454 (954)  | - - - - - - - - - - - - - - A S R H V D N D K D H D M I | D | Y I |

Fig. 18I

| Sequence Name (SEQ ID NO.) | 280 | 290 | 300 |
|---|---|---|---|
| G3809 (1012) | L C R I Y K - - - - - - - - - - - - - - - - - - - - - - - - K K |
| pG3807 (1222) | E A N G E L S S - - - - - - - - - - - - - - - - - - - - - - F A |
| pG521 (1223) | D K E E E - - - - - - - - - - - - - - - - - - - - - - - - - - |
| pG3041 (690) | E E D D M T F V P D - - - - - - - - - - - - - - - - Q E D L |
| pG3832 (1224) | - - - - - - - - - - - - - - - - - - - - - - - - - - - - - - |
| pG515 (20) | Q S R R D - - - - - - - - - - - - - - - - - - - - - - - - - - |
| pG2053 (10) | Q S R - D - - - - - - - - - - - - - - - - - - - - - - - - - - |
| pG516 (22) | H T H - - - - - - - - - - - - - - - - - - - - - - - - - - - - |
| pG517 (24) | Q I H - - - - - - - - - - - - - - - - - - - - - - - - - - - - |
| pG513 (1225) | M S E V S P V F P - - - - - - - - - - - - - - - - - - - - K T |
| pG960 (1226) | S D L V Q E T P S S - - - - - - - - - - - - - - - - - - - D A |
| pG3834 (1227) | S E M V Q E T D T S - - - - - - - - - - - - - - - - - - - R V |
| pG1455 (1228) | S E M V Q E T A T S - - - - - - - - - - - - - - - - - - - G V |
| pG3805 (1229) | S S S F S F P T E T P M D S M H G G F G M Q M S A P H E D G |
| pG958 (520) | N S G Y P V S P E T G G L T Q L G N N S S S D M E T I E N - |
| pG1924 (1230) | S E R - - - - - - - - - - - - - - - - - - - - - - - - - - - - |
| pG518 (612) | I S S N T P Y N T A A H I Q P R F G N A N A - - I S D H D - |
| pG3808 (1231) | T D V G P - - - - - - - - - - - - - - - - - - - - - - - - - - |
| pG3833 (1232) | N E M V Y - - - - - - - - - - - - - - - - - - - - - - - - S S |
| pG523 (1233) | T G S S - - - - - - - - - - - - - - - - - - - - - - - - - - - |
| pG514 (1234) | T D F N P - - - - - - - - - - - - - - - - - - - - - - - - S - |
| pG3806 (1235) | R N D S F - - - - - - - - - - - - - - - - - - - - - - - - D L |
| pG526 (1236) | R M D - - - - - - - - - - - - - - - - - - - - - - - - - - S L |
| pG1454 (954) | F R K I P - - - - - - - - - - - - - - - - - - - - - - - - - - |

Fig. 18J

| Sequence Name (SEQ ID NO.) | 310 | 320 | 330 |
|---|---|---|---|
| G3809 (1012) | E A N Q Q L Q H Y I D | - - - - - - - - - - - - | - - - - |
| pG3807 (1222) | F S V P P C A L E S S N | - - - - - - - - - - - | G R L N T A G |
| pG521 (1223) | Y T Q N H L V A G P S | - - - - - - - - - - - - | - - - K E |
| pG3041 (690) | G S E D H V Y V H M D D | I D Q K S E N F V V Y D | A I P I P L |
| pG3832 (1224) | - - - - - - - - - - - - | - - - - - - - - - - - - | - - - - |
| pG515 (20) | S L I P Q L V N | - - - - - - - - - - - - | - - N S E G |
| pG2053 (10) | S L I P L L V N | - - - - - - - - - - - - | - - - D S E - |
| pG516 (22) | S L I P P T N N S G V L | - - - - - - - - - - - | S V E T E G |
| pG517 (24) | S L I P L V N S | - - - - - - - - - - - - | - - S G G S E G |
| pG513 (1225) | E E T N P C D V A E S S | L V I P S E C R S G Y S | V P E V T T |
| pG960 (1226) | A V E K P S D Y S G G C | G Y A H S N - - - - - - | - S T A D G |
| pG3834 (1227) | H A Q N I S D D T E R C | P R D Q G | |
| pG1455 (1228) | H A L D R S D D T E R C | L S D K G N N D V K P D | V S V I N N |
| pG3805 (1229) | K W M Q F L S E D A F N | A T N P F L T N P V S A | N F S C L P |
| pG958 (520) | K W S Q F M S H D T S F | N F P P Q S Q - - - | Y G T I S Y P P |
| pG1924 (1230) | - - - - - - - - - - - - | - - - - - - - - - - - - | - - - - |
| pG518 (612) | D W S Q Y L S Q N M P T | S F S D Y G S - - - | P Y G P Y L T Q |
| pG3808 (1231) | S S M P M A D D V V G | - - - - - - - - - - - - | L A P C A L P |
| pG3833 (1232) | S A L P P L T D S S P S | - - - - - - - - - - - | I G N N T K A L |
| pG523 (1233) | - - L P P L T D S S P | - - - - - - - - - - - - | - - Y N D K |
| pG514 (1234) | - L L P S L T D S S P | - - - - - - - - - - - - | - - Y N D K |
| pG3806 (1235) | D L D D F L H L D A D | - - - - - - - - - - - - | - - - L P |
| pG526 (1236) | E N I D H L L D F S S | - - - - - - - - - - - - | - - - L P |
| pG1454 (954) | P S L S M A A A S T G | - - - - - - - - - - - - | - L H Q H H |

Fig. 18K

| Sequence Name (SEQ ID NO.) | | | 340 | | | | | | | | | | | | | 350 | | | | | | | | | 360 | | |
|---|---|---|---|---|---|---|---|---|---|---|---|---|---|---|---|---|---|---|---|---|---|---|---|---|---|---|---|
| G3809 (1012) | M | M | M | D | D | - | - | - | - | - | - | - | - | - | - | - | - | - | D | N | D | D | E | - | - | - |
| pG3807 (1222) | Q | Q | L | A | V | S | D | N | - | - | - | - | - | - | - | - | I | G | S | S | L | D | H | C | S | E | T | N | D |
| pG521 (1223) | T | S | L | A | A | K | - | - | - | - | - | - | - | - | - | - | - | - | - | - | A | S | H | S | Y | A | P | - |
| pG3041 (690) | N | F | I | H | G | E | S | S | - | - | - | - | - | - | - | - | - | - | N | N | V | E | T | N | Y | S | D | S | I | N |
| pG3832 (1224) | - | - | - | - | - | - | - | - | - | - | - | - | - | - | - | - | - | - | - | - | - | - | - | - | - | - |
| pG515 (20) | S | S | L | H | R | E | D | P | S | Q | F | G | D | V | L | Q | E | A | P | I | E | D | A | K | L | T | E | E | L | V |
| pG2053 (10) | - | - | - | - | - | - | - | - | - | - | - | - | - | - | - | - | - | - | - | - | - | - | - | - | - | E | - | - |
| pG516 (22) | S | L | F | H | S | Q | - | - | - | - | - | - | - | - | - | - | - | - | - | E | S | Q | N | P | S | Q | F | S | G |
| pG517 (24) | S | S | F | H | S | Q | - | - | - | - | - | - | - | - | - | - | - | - | - | E | L | Q | N | S | S | Q | S | G | V |
| pG513 (1225) | T | G | L | D | D | I | D | - | - | - | - | - | - | - | - | - | - | - | - | W | L | S | F | M | E | F | D | - |
| pG960 (1226) | T | M | I | E | A | P | E | - | - | - | - | - | - | - | - | - | - | - | E | N | L | W | L | S | C | D | L | E | D | - |
| pG3834 (1227) | | | | | | | | | | | | | | | | | | | | | | | | | | | | |
| pG1455 (1228) | T | S | V | N | H | A | E | T | S | R | A | K | D | - | - | - | - | - | R | N | L | G | K | T | L | V | E | E | N | P |
| pG3805 (1229) | S | K | V | D | V | A | L | E | - | - | - | - | - | - | - | - | - | - | C | A | R | L | Q | H | R | L | T | L | P | P |
| pG958 (520) | S | K | V | D | I | A | L | E | - | - | - | - | - | - | - | - | - | - | C | A | R | L | Q | N | R | M | L | P | P | V |
| pG1924 (1230) | - | - | - | - | - | - | - | - | - | - | - | - | - | - | - | - | - | - | - | - | - | - | - | - | - | - | - | - |
| pG518 (612) | S | K | V | N | T | E | V | Q | - | - | - | - | - | - | - | - | - | - | C | E | M | F | Q | H | Q | M | S | L | P | P |
| pG3808 (1231) | P | L | M | D | V | S | - | - | - | - | - | - | - | - | - | - | - | - | - | - | G | G | G | G | G | - | - | - | - |
| pG3833 (1232) | S | V | T | D | S | A | Y | - | - | - | - | - | - | - | - | - | - | - | - | V | P | C | F | S | N | P | I | D | V | P | R |
| pG523 (1233) | T | K | T | E | P | V | Y | - | - | - | - | - | - | - | - | - | - | - | - | V | P | C | F | S | N | Q | A | E | T | R | - |
| pG514 (1234) | T | K | T | E | P | V | Y | - | - | - | - | - | - | - | - | - | - | - | - | V | P | C | F | S | N | Q | T | D | Q | N | Q |
| pG3806 (1235) | P | L | I | D | - | - | - | - | - | - | - | - | - | - | - | - | - | - | - | D | P | F | A | S | T | S | - | - | - |
| pG526 (1236) | P | L | I | D | - | - | - | - | - | - | - | - | - | - | - | - | - | - | - | P | S | F | M | S | Q | T | E | Q | P | - |
| pG1454 (954) | H | N | V | S | R | S | M | N | - | - | - | - | - | - | - | - | - | - | - | F | F | P | G | K | F | S | G | G | - |

Fig. 18L

| Sequence Name (SEQ ID NO.) | 370 | 380 | 390 |
|---|---|---|---|
| G3809 (1012) | | | |
| pG3807 (1222) | K I A V G G C G | | |
| pG521 (1223) | | | |
| pG3041 (690) | Y I Q Q T G N Y M D S G G Y F E Q P A E S Y E | | |
| pG3832 (1224) | | | |
| pG515 (20) | K W L M N D | | |
| pG2053 (10) | | | |
| pG516 (22) | F L D V D A | | |
| pG517 (24) | F A N V Q G | | |
| pG513 (1225) | | S P K L F S P | |
| pG960 (1226) | | Q K A P L P | |
| pG3834 (1227) | | | |
| pG1455 (1228) | L L R D V P T L H G P I L S E K S Y Y P G Q | | |
| pG3805 (1229) | L E V E D F P Q D V S L D T K I G I L R S N P N E V D I L Q | | |
| pG958 (520) | P P L Y V E G L T H N E Y F G N N V A N D T | | D |
| pG1924 (1230) | | | |
| pG518 (612) | L R V E N S Q A Q T S D F S K R | | |
| pG3808 (1231) | | | |
| pG3833 (1232) | G | | I |
| pG523 (1233) | | | |
| pG514 (1234) | | | |
| pG3806 (1235) | | | |
| pG526 (1236) | | | |
| pG1454 (954) | | | |

Fig. 18M

| Sequence Name (SEQ ID NO.) | 400 | 410 | 420 |
|---|---|---|---|
| G3809 (1012)   | - - - - - - - - - - - - - - | H N L | Q V Q Q Q Q Q Q A |
| pG3807 (1222)  | - - - - - - - T T S P S V P F D | T I | H T Q Q L D E I I S |
| pG521 (1223)   | - - - - - - - - - - - - - K D | G L | T G V I S E S C V S |
| pG3041 (690)   | - - - - - K D Q K P I I R D R D G | S L | Q N E G I G C G V Q |
| pG3832 (1224)  | - - - - - - - - - - - - - - - - - - - - - |  |  |
| pG515 (20)     | - - - - - - - - - - E D D A Q I E D A | I | P I E E W E T W L N |
| pG2053 (10)    | - - - - - - - - - - - - E A Q I E D A | I | P I E E W E T W L T |
| pG516 (22)     | - - - - - - - - - - L D - - R D F C N | I | L S D D F K G F F N |
| pG517 (24)     | - - - - - - - - - - E S Q I D D A T | T | P I E E E W K T W L N |
| pG513 (1225)   | - - - - - - - - - - - - - L H | S | Q V Q S E L G S S F N |
| pG960 (1226)   | - - - - - - - - - - - - - C M D | S I | Y A G D F S Y D E I |
| pG3834 (1227)  |  |  |  |
| pG1455 (1228)  | - - - - - - - S S I G F A T S H M D | S | M Y S S D F G N C D Y |
| pG3805 (1229)  | E F L S V A T A S Q E L I N G S T S | S | Y P E M W L G A S T S |
| pG958 (520)    | E M L S K I I A L A Q A S H E P R N | S L | D S W D G G S A S G |
| pG1924 (1230)  | - - - - - - - - - - - - Q L Q T G Q C | S | F T T A S M E E I N S |
| pG518 (612)    | - - - - - - - - - - L H Q N S G Q S G | F | D D F T F A T S N S |
| pG3808 (1231)  | - - - - - - - - - - - - A G T T | S L | S A T A G A A A A P |
| pG3833 (1232)  | - - - - - - - - - - - - - - F D | S L | N N I N I S I N S N |
| pG523 (1233)   | - - - - - - - - - - - - - - G T | I L | N C F S N P S L S S |
| pG514 (1234)   | - - - - - - - - - - - - - - G T | T L | N C F S S P V L N S |
| pG3806 (1235)  | - - - - - - - - - - - - - - - - - | T L | K T E P P P - - - - |
| pG526 (1236)   | - - - - - - - - - - - - - - - - - N | F K | P I N P P T Y D I |
| pG1454 (954)   | - - - - - - - - - - - - - - G Y G | I | F S D G G N T S I Y |

Fig. 18N

| Sequence Name (SEQ ID NO.) | 430 | 440 | 450 |
|---|---|---|---|
| G3809 (1012) | Q S H R M P R | - - - - - - - - - - - - - - - - | - - P P |
| pG3807 (1222) | C F S T D L L N S V S | - - - - - - - - - - - - - - | - R D G |
| pG521 (1223) | D V P P L T A T | - - - - - - - - - - - - - - - | - V L P |
| pG3041 (690) | D K H S E T L Q S S D | - - - - - - - - - - - | N I F G T D T S |
| pG3832 (1224) | - - - - - - - - - - - - - - - - - - - - - - - - - | | |
| pG515 (20) | D I D D A K E K | - - - - - - - - - - - - - - - - | - - S I M |
| pG2053 (10) | D D G V D E Q V N | - - - - - - - - - - - - - - - | - - H I M |
| pG516 (22) | D D - D E Q S K | - - - - - - - - - - - - - - - - | - - - I V |
| pG517 (24) | N D G D E Q R N | - - - - - - - - - - - - - - - - | - - - I M |
| pG513 (1225) | G L Q S E S | - - - - - - - - - - - - - - - - - - | - - - - |
| pG960 (1226) | G F Q F Q D G T S | - - - - - - - - - - - - - | E P D V S L T E |
| pG3834 (1227) | | | |
| pG1455 (1228) | G L H F Q D G A S | - - - - - - - - - - - - - | E Q D A S L T D |
| pG3805 (1229) | S A S Y V N E L S S L V E M G G V G T S N H H E S A R L Q V | | |
| pG958 (520) | N F H G D F N Y S G E K V S C | - - - - - - | L E A N V E A V |
| pG1924 (1230) | N - - - - - - - - - - - - - - - - - - - - - - - - | | |
| pG518 (612) | N Q F Y N S N V D | - - - - - - - - - - - - - - | D H L I H I G |
| pG3808 (1231) | P A A H V T C F S | - - - - - - - - - - - - - - - | - - - - N |
| pG3833 (1232) | T L Y G V S S | - - - - - - - - - - - - - - - - - | - - N H S |
| pG523 (1233) | I Q P D F L Q | - - - - - - - - - - - - - - - - - | - - M I P |
| pG514 (1234) | I Q A D I F H | - - - - - - - - - - - - - - - - - | - - R I P |
| pG3806 (1235) | - - - - - - - - - - - - - - - - - - - - - - - - - | | |
| pG526 (1236) | S S P I Q P H | - - - - - - - - - - - - - - - - - | - - H F N |
| pG1454 (954) | D G G G | - - - - - - - - - - - - - - - - - - - - - | - - M I N |

Fig. 18O

| Sequence Name (SEQ ID NO.) | 460 | 470 | 480 |
|---|---|---|---|
| G3809 (1012) | S I S D Y L L D Y S | | |
| pG3807 (1222) | S L P D S T A D Y D | | |
| pG521 (1223) | P L T S D V I A Y N P F S | | |
| pG3041 (690) | C Y N D F P V E S N Y L I G E A F L D | | |
| pG3832 (1224) | | | |
| pG515 (20) | F M H D N R S D Y R P P | | |
| pG2053 (10) | N M K D D R N N H R P Q | | |
| pG516 (22) | S M Q D D R N N H T P Q | | |
| pG517 (24) | F M Q D H R S D Y T P L | | |
| pG513 (1225) | - - S E L F K N H N - - - - - - E D Y I Q T | | |
| pG960 (1226) | L L E E V F N N P D D F S C E E S I S R E N P A V S P N G I | | |
| pG3834 (1227) | | | |
| pG1455 (1228) | V L D E V F H N H N - - - - E S S N D R K D - F V L P N - M | | |
| pG3805 (1229) | E I A D M E V F K D E K K | | |
| pG958 (520) | D M Q E H H V N F K E E R | | |
| pG1924 (1230) | - - N N N N Y N N D Y E | | |
| pG518 (612) | N L D E Q S Y I E E Q E | | |
| pG3808 (1231) | A L E G Q F L D T P Y L L P | | |
| pG3833 (1232) | F Y N T Q G V Q L Q A P | | |
| pG523 (1233) | L Y Q P Q S L N I S E | | |
| pG514 (1234) | L Y Q T Q S L Q V S M N | | |
| pG3806 (1235) | P A N L M H N H Y G Y F | | |
| pG526 (1236) | S Y Q S I F N H Q V F G | | |
| pG1454 (954) | N I G T D S V D H D N | | |

Fig. 18P

| Sequence Name (SEQ ID NO.) | 490 | 500 | 510 |
|---|---|---|---|

```
                              490            500           510
G3809   (1012)      - - - - - - D D L P P S T D Q T P S L H L G F T A V N - - -
pG3807  (1222)      - - - - - - - N D N E V S S D D G E A I F N E L D E L D S Q
pG521   (1223)      - - - - - - - S S P L L E V P Q V S L D G G E L N S M L D L
pG3041  (690)       - - - - - - - P N S N L L E N D G L Y L E T N D L S S T Q Q D
pG3832  (1224)      - - - - - - - - - - - V H V L L - - - - - - - - - - - - - -
pG515   (20)        - - - - - - - N S L T G V F S D D V S S D D N D S D L L T P K
pG2053  (10)        - - - - - - - K P L T G V L I D D S S D D D D D S D L L S P T
pG516   (22)        - - - - - - - K P L T G V F S D H - S T D G S D S D P I S A T
pG517   (24)        - - - - - - - K S L T G V F S D D - S S D D N D S D L I S P K
pG513   (1225)      - - - - - Q Y G T N D A D E Y M S K F L D S F L D I P Y E P
pG960   (1226)      F S S A K M L Q S A A P E D A F F N D F M A F T D T D A E M
pG3834  (1227)
pG1455  (1228)      M H W P G N T R L L S T E Y P F L K D S V A F V D G S A E V
pG3805  (1229)      - - - - R V E N L R G V K L V N N D L G E I V V E G D E S N
pG958   (520)       - - - - L V E N L R W V G V S S K E L E K S F V E E H S T V
pG1924  (1230)      - - - - - - T M S P E V G V S S A C V E E V V D - - - - - -
pG518   (612)       - - - - - L I L P S F Q S N D Q D L E L Y G G S R T N T I
pG3808  (1231)      - - - - - - - A A D P A D H L A M S S A S P F L E A L Q M Q
pG3833  (1232)      - - - - - - - P T L P L P S S S N H Y L R A F L E N Q G N G
pG523   (1233)      - - - - - - - S S N P V L T Q E Q S V L Q A M M E N - - - -
pG514   (1234)      - - - - - - - L Q S P V L T Q E H S V L H A M I E N - - - -
pG3806  (1235)      - - - - - - - S L P A S A T N Y N - - - - - - - - - - - - -
pG526   (1236)      - - - - - - - S A S G S T Y N N N E M I K M E Q S - - - -
pG1454  (954)       - - - - - - - N A D V V G L N H A S S S G P M M M A N - - -
                                        V
```

Fig. 18Q

| Sequence Name (SEQ ID NO.) | 520 | 530 | 540 |
|---|---|---|---|
| G3809 (1012)  | - - - - - - - - - - - - - - - - - - - E G N N K - - - - - - |
| pG3807 (1222) | S - - - - - - - - - - - - - - - - D E S I S N H C N S C G - - |
| pG521 (1223)  | F S - - - - - - - - - - - - - - - - - V D N D D C L L F D - - |
| pG3041 (690)  | G F D F E D Y L T F F D E T F D P S Q L M G N E D V F F D Q |
| pG3832 (1224) | - - - - - - - - - - - - - - - - P F F F L L S L C F C Y H S V |
| pG515 (20)    | T - - - - - - - - - - - - - - - - N S I Q T S S T C D S F G S S |
| pG2053 (10)   | T - - - - - - - - - - - - - - - - N S I E N S S T C D S F G S S |
| pG516 (22)    | T - - - - - - - - - - - - - - - - I S I Q T L S T C P S F G S S |
| pG517 (24)    | T - - - - - - - - - - - - - - - - N S I G T S S T C A S F A S S |
| pG513 (1225)  | E Q I P Y E P - - - - - - - - - - - Q N L S S C N K I N - - |
| pG960 (1226)  | A Q L Q Y G S - E G G A S G W P S D T N S Y Y S D L V Q - - |
| pG3834 (1227) | |
| pG1455 (1228) | S G S Q Q F V P D I L A S R W V S E Q N V D S K E A V E I L |
| pG3805 (1229) | P T E D I I A Q Y P I K V T A D N S G E A G H R M T D P T D |
| pG958 (520)   | I P I E D I W R Y H N D N Q E Q E H H D Q D G M D V N N N N |
| pG1924 (1230) | - - - - - - - - - - - - - - - - - - - D K D D S - - - - - - |
| pG518 (612)   | G N I E I D D F F S F E N Q A Q - - - D N D N S N V T P N - |
| pG3808 (1231) | Y - - - - - - - - - - - - - - - - - V Q D A A A A G G A G - - |
| pG3833 (1232) | S - - - - - - - - - - - - - - - - - N M S N N G F E P E - |
| pG523 (1233)  | - - - - - - - - - - - - - - - - - - - N R R Q N - - - - - - |
| pG514 (1234)  | - - - - - - - - - - - - - - - - - - - N R R Q S - - - - - - |
| pG3806 (1235) | |
| pG526 (1236)  | - - - - - - - - - - - - - - - - - - - L V S V S - - - - - - |
| pG1454 (954)  | - - - - - - - - - - - - - - - - - - - L K R T L P V P - - |

Fig. 18R

| Sequence Name (SEQ ID NO.) | 550 | 560 | 570 |
|---|---|---|---|
| G3809 (1012) | - - - - - - - - - | - - - - - - - - - - | - - - - - - - - - - - |
| pG3807 (1222) | - - - - - - - - - | - - - - - - - - - - | - - - - - - - - - - - |
| pG521 (1223) | - - - - - - - - - | - - - - - - - - - - | - - - - - - - - - - - |
| pG3041 (690) | E E - - - - - - - | - - - - - - - - - - | - - - - - - - - - - - |
| pG3832 (1224) | | | |
| pG515 (20) | N H R - - - - - - | - - - - - - - - - - | - - - - - - - - - - - |
| pG2053 (10) | - - - - - - - - - | - - - - - - - - - - | - - - - - - - - - - - |
| pG516 (22) | N P - - - - - - - | - - - - - - - - - - | - - - - - - - - - - - |
| pG517 (24) | N - - - - - - - - | - - - - - - - - - - | - - - - - - - - - - - |
| pG513 (1225) | - - - - - - - - - | - - - - - - - - - - | - - - - - - - - - - - |
| pG960 (1226) | - - - - - - - - - | - - - - - - - - - - | - - - - - - - - - - - |
| pG3834 (1227) | | | |
| pG1455 (1228) | S S T G S S R T L | T P L H N N V F G Q | Y A S S S Y A A I D P |
| pG3805 (1229) | V G G I D T A P I | F S Q S Q P D D - - | - - - - - - - - - - - |
| pG958 (520) | G D V D D A F T L | E F S E N E H N E N | L - - - - - - - - - - |
| pG1924 (1230) | - - - - - - - - - | - - - - - - - - - - | - - - - - - - - - - - |
| pG518 (612) | - - - - - - - - - | - - - - - - - - - - | - - - - - - - - - - - |
| pG3808 (1231) | - - - - - - - - - | - - - - - - - - - - | - - - - - - - - - - - |
| pG3833 (1232) | - - - - - - - - - | - - - - - - - - - - | - - - - - - - - - - - |
| pG523 (1233) | - - - - - - - - - | - - - - - - - - - - | - - - - - - - - - - - |
| pG514 (1234) | - - - - - - - - - | - - - - - - - - - - | - - - - - - - - - - - |
| pG3806 (1235) | - - - - - - - - - | - - - - - - - - - - | - - - - - - - - - - - |
| pG526 (1236) | - - - - - - - - - | - - - - - - - - - - | - - - - - - - - - - - |
| pG1454 (954) | - - - - - - - - - | - - - - - - - - - - | - - - - - - - - - - - |

Fig. 18S

| Sequence Name (SEQ ID NO.) | 580 | 590 | 600 |
|---|---|---|---|
| G3809 (1012) | | | - - - - - - - - - - - - - - - - - R H K T M |
| pG3807 (1222) | | - - - - - - - - - - - - - E D L I P P T L E V | L |
| pG521 (1223) | | - - - - - - - - - - - - - - - D F D Y H N E | V |
| pG3041 (690) | | - - - - - - - - - - - L F Q E V E T K E L E K E E T S | |
| pG3832 (1224) | | | |
| pG515 (20) | | - - - - - - - - - - - - - - - I D Q I K D L Q E | |
| pG2053 (10) | | - - - - - - - - - - - - - - - - - - - - - - - | |
| pG516 (22) | | - - - - - - - - - - - - - - - L Y Q I T D L Q E | |
| pG517 (24) | | - - - - - - - - - - - - - - - H Q I D Q T Q H | |
| pG513 (1225) | | - - - - - - - - - - - - - D E S K - R G I K | I |
| pG960 (1226) | - - - - - - - - Q E Q M I N H N T E N N L T E G R G I K | | I |
| pG3834 (1227) | | | |
| pG1455 (1228) | F N Y N V N Q P E Q S S F E Q S H V D R N I S P S N I F E F | | |
| pG3805 (1229) | | - - - - - - - F A A G F D D V N P N A S F D L Y E K V D | V |
| pG958 (520) | | - - - - - - - L D K N D H E T T S S S C F E V V K K V E | V |
| pG1924 (1230) | | | |
| pG518 (612) | | - - - - - - - - - - - - S A G F E M I G E E I I | V |
| pG3808 (1231) | | - - - - - - - - - - - - - - - - M V H E L L M | |
| pG3833 (1232) | | - - - - - - - - - - - - - - - - - R E M V S | V |
| pG523 (1233) | | - - - - - - - - - - - - - - - - - F K T L S | I |
| pG514 (1234) | | - - - - - - - - - - - - - - - - - L K T M S | V |
| pG3806 (1235) | | - - - - - - - - - - - - - - - - - H S S G | A |
| pG526 (1236) | | - - - - - - - - - - - - - - - - - Q E T C | L |
| pG1454 (954) | | - - - - - - - - - - - - - - - - - Y W P V | A |

Fig. 18T

| Sequence Name (SEQ ID NO.) | 610 | 620 | 630 |
|---|---|---|---|
| G3809 (1012) | E E Y Y S I S I S T A D M L H A S S S T S N N K - - - - - - | | |
| pG3807 (1222) | K T E Q Y L E L N D L S F S L A D D P D P C N L L L T T N L | | |
| pG521 (1223) | R H P D G F V N K E A P V F L G D G N F S G M F D L S N D Q | | |
| pG3041 (690) | R S K H V V E E K E K D E A S C S K Q V D A D A T E F E P D | | |
| pG3832 (1224) | | | |
| pG515 (20) | S P T S T I N L V S L T Q E V S Q A L I T S I D T A E K K K | | |
| pG2053 (10) | - - - D Q I N L V S L T Q E V S Q A L I T S I D T P E K I K | | |
| pG516 (22) | S P N - S I K L V S L A Q E V S K T P G T G I D N D - - - - | | |
| pG517 (24) | S P D S T V Q L V S L T Q E V S Q G P G - - - - - - - - - - | | |
| pG513 (1225) | R A R R A Q A P G C A E Q F V M Q G D A S R R L R L Q V N L | | |
| pG960 (1226) | R A R Q P Q N - R Q S T G L I N Q G I A P R R I R L Q L Q S | | |
| pG3834 (1227) | | | |
| pG1455 (1228) | K A R S R E N Q R D L D S V V D Q G T A P R R I R L Q I E Q | | |
| pG3805 (1229) | N H R L F V S R V A A A K T F F H R I E P S K K V S F H S N | | |
| pG958 (520) | S H G L F V T T R Q V T N T F F Q Q I V P S Q T V I V Y I N | | |
| pG1924 (1230) | - - - - - - - - - - - - - - - - - - - - - - - - - - - - - | | |
| pG518 (612) | N H K M L I S T R Q T T E I L Y Y Q V V P S Q I L K I H I N | | |
| pG3808 (1231) | G G G W Y C N K G E R E R L S G A S Q D T G - - - - - - - - | | |
| pG3833 (1232) | S Q K T S L S T D V K A E I S S L G K R H F E N - - - Q N N | | |
| pG523 (1233) | S Q E T G V S N - - - T D N S S V F E F G R K R - - - F D H | | |
| pG514 (1234) | S Q E T G V S T D M N T D I S S D F E F G K R R - - - F D S | | |
| pG3806 (1235) | M A D Q A I R R F C K A E A S T A C F S G A D A - - - D V D | | |
| pG526 (1236) | S S D V N A N M T T T T E V S S G P V M K Q E M - - - G M M | | |
| pG1454 (954) | D E E Q D A S P S K R F H G V G G G G G D C S N - - - - - - | | |

Fig. 18U

| Sequence Name (SEQ ID NO.) | 640 | 650 | 660 |
|---|---|---|---|
| G3809 (1012) | - - - - - - - - - - - - - - - - - - - - - - - - | | |
| pG3807 (1222) | S - - - - - - - - - - - - - - - - - - - - - - - | | |
| pG521 (1223) | - - - - - - - - - - - - - - - - - - - - - - - - | | |
| pG3041 (690) | Y K Y P L L K K A S H M L G - - - - - - - - - - | | |
| pG3832 (1224) | | | |
| pG515 (20) | N - - - - - - - - - - - - - - - - - - - - - - - | | |
| pG2053 (10) | S - - - - - - - - - - - - - - - - - - - - - - - | | |
| pG516 (22) | - - - - - - - - - - - - - - - - - - - - - - - - | | |
| pG517 (24) | - - - - - - - - - - - - - - - - - - - - - - - - | | |
| pG513 (1225) | N - - - - S H K S E T - - - - - - - - - - - - - | | |
| pG960 (1226) | - - - - N S E V K E R - - - - - - - - - - - - - | | |
| pG3834 (1227) | | | |
| pG1455 (1228) | P L T P V T N K K E R D A D N Y - - - - - - - - | | |
| pG3805 (1229) | P - - - - - A A T A V S K A T E K F H F P V T T K V S G R V | | |
| pG958 (520) | P - - - - - T D G N E C C H S M T S K E E V H V R K K I N P | | |
| pG1924 (1230) | - - - - - - - - - - - - - - - - - - - - - - - - | | |
| pG518 (612) | P - - - - - V H G N - - - - - - - - - - - - - - | | |
| pG3808 (1231) | - - - - - - - - - - - - - - - - - - - - - - - - | | |
| pG3833 (1232) | P - - - - - I A S - - - - - - - - - - - - - - - | | |
| pG523 (1233) | Q - - - - - E V P - - - - - - - - - - - - - - - | | |
| pG514 (1234) | Q - - - - - E D P - - - - - - - - - - - - - - - | | |
| pG3806 (1235) | P - - - - - V V D E - - - - - - - - - - - - - - | | |
| pG526 (1236) | G - - - - - M V N G - - - - - - - - - - - - - - | | |
| pG1454 (954) | - - - - - - - - - - - - - - - - - - - - - - - - | | |

Fig. 18V

| Sequence Name (SEQ ID NO.) | 670 | 680 | 690 |
|---|---|---|---|
| G3809 (1012) | | | - - - S T Q I N |
| pG3807 (1222) | | | - - D Q N H P E L |
| pG521 (1223) | | | - V V E L Q D L I Q S |
| pG3041 (690) | | | A I P A P L A N A S E F |
| pG3832 (1224) | | | |
| pG515 (20) | | | - - P Y D D A Q G T E I G |
| pG2053 (10) | | | - - P Y D D A Q G T G A G |
| pG516 (22) | | | - - - - - A Q G T E I G |
| pG517 (24) | | | - - - - - - Q V T V I R |
| pG513 (1225) | | | - - D S T Q L Q F I K K E |
| pG960 (1226) | | | - E E V N E G H T V I P E |
| pG3834 (1227) | | | |
| pG1455 (1228) | | | E E E D E V Q S A M S K |
| pG3805 (1229) | S I F S K F K A L I R | - - - - - - - - - - - - | - D K F L M M R |
| pG958 (520) | R I N G V S S T V L G | Q W R K F A H V I G F I | P M L L L M R |
| pG1924 (1230) | | | - - - - - - - W M Q |
| pG518 (612) | | | - - - - E E R T M L M E |
| pG3808 (1231) | | | - - - - - - - L T S S |
| pG3833 (1232) | | | - - - - - - A A A V A |
| pG523 (1233) | | | - - - - - - S P S S G |
| pG514 (1234) | | | - - - - - - S S S T G |
| pG3806 (1235) | | | - - - - - L L S F P D S |
| pG526 (1236) | | | - - - - - S K S Y E D L |
| pG1454 (954) | | | - - - - - M S S S M M E |

Fig. 18W

| Sequence Name (SEQ ID NO.) | 700 | 710 | 720 |
|---|---|---|---|
| G3809 (1012) | F S S I F E P | | |
| pG3807 (1222) | E T R F E Q G S | | |
| pG521 (1223) | P T P H P P | | |
| pG3041 (690) | P T K D A A I R L H A A Q S S | | |
| pG3832 (1224) | | | |
| pG515 (20) | E H K L G Q E T | | |
| pG2053 (10) | G Q K L G Q E T | | |
| pG516 (22) | E H K L G Q E T | | |
| pG517 (24) | E H K L G E E S | | |
| pG513 (1225) | V K D T T T E T M T K G C G | | |
| pG960 (1226) | A K E A A A K Y S E K S G S | | |
| pG3834 (1227) | | | |
| pG1455 (1228) | V V E E E P A N L S A Q G T A | | Q R R I R L |
| pG3805 (1229) | P S H S Y Q R L G S K E T T V N E L L Q I V S L L L A P K Q | | |
| pG958 (520) | C V H R G N S N K N R | | G S E G Y S R Q P T |
| pG1924 (1230) | F I T D D A | | |
| pG518 (612) | E D S D D S | | |
| pG3808 (1231) | E V N P G E | | |
| pG3833 (1232) | P M D L A T | | |
| pG523 (1233) | P V D L E P | | |
| pG514 (1234) | P V D L E P | | |
| pG3806 (1235) | I T D Y S Y | | |
| pG526 (1236) | C D L R G D | | |
| pG1454 (954) | E T P P L M Q | | |

Fig. 18X

| Sequence Name (SEQ ID NO.) | 730 | 740 | 750 |
|---|---|---|---|
| G3809 (1012)   | - - - - - - - - - - - - - - - - - - - - - - - Q T P A A A G |
| pG3807 (1222)  | - - - - - - - - - - - - - - - - - - - - - L V D I C N T T N |
| pG521 (1223)   | - - - - - - - - - - - - - - - - - - - - - S P P A Q A S I P |
| pG3041 (690)   | - - - - G S V H V T A G M I T I S D S N M G W S Y G K N E N |
| pG3832 (1224)  | |
| pG515 (20)     | - - - - - - - - - - - - - - - - - - - - - I K K K R A G F F |
| pG2053 (10)    | - - - - - - - - - - - - - - - - - - - - - R E K K R A G F F |
| pG516 (22)     | - - - - - - - - - - - - - - - - - - - - - I K N K R A G F F |
| pG517 (24)     | - - - - - - - - - - - - - - - - - - - - - V K K K R A S F V |
| pG513 (1225)   | - - - - - - - - - - - - - - - - - - - - - N F T R S K S R T |
| pG960 (1226)   | - - - L V K P Q I K L R - - - - - - - - A R G T I G Q V K G |
| pG3834 (1227)  | |
| pG1455 (1228)  | Q T R L R K P L I T L N N T K R N S N G R E G E A S H R K C |
| pG3805 (1229)  | I N G C P T E Q E L V K K K A K E V M K P G W G R E G S N K |
| pG958 (520)    | R G D C N N R G T I L M M E N A V V R R K I W K K K K E K N |
| pG1924 (1230)  | - - - - - - - - - - - - - - - - - - - - - - W D T S S N G - |
| pG518 (612)    | - - - - - - - - - - - - - - - - - - - - - - W F Q K A E N - |
| pG3808 (1231)  | - - - - - - - - - - - - - - - - - - - - - - I S S S S R H N |
| pG3833 (1232)  | - - - - - - - - - - - - - - - - - - - - - - - - - - L W N Y |
| pG523 (1233)   | - - - - - - - - - - - - - - - - - - - - - - - - - - F W N Y |
| pG514 (1234)   | - - - - - - - - - - - - - - - - - - - - - - - - - - F W N Y |
| pG3806 (1235)  | - - - - - - - - - - - - - - - - - - - - - - - - - - - I W K A |
| pG526 (1236)   | - - - - - - - - - - - - - - - - - - - - - - - - - - - L W D F |
| pG1454 (954)   | - - - - - - - - - - - - - - - - - - - - - - - Q Q G G V L G |

Fig. 18Y

| Sequence Name (SEQ ID NO.) | 760 | 770 | 780 |
|---|---|---|---|
| G3809 (1012) | H Q L M S S H N D D T S I | | |
| pG3807 (1222) | A T I S N A A C S A S T V G D H V T | | |
| pG521 (1223) | D - - - D S R S N G Q T K D D | | |
| pG3041 (690) | L D L I L S L G L V Q G N T A P E K S G N S S A W A M L I F | | |
| pG3832 (1224) | | | |
| pG515 (20) | H R M I Q K F V K K I H L C S S I S R T | | |
| pG2053 (10) | H R M I Q I F V K K I H Q C S S I S R T | | |
| pG516 (22) | H R M I Q K F V K K I H L R T | | |
| pG517 (24) | Y R M I H R L V K K I H Q C Y S I S R T | | |
| pG513 (1225) | S F I F K K I A A M G C S Y R G L F R V G - - - - - - - - - | | |
| pG960 (1226) | E R F A D D E V Q V Q S T K R E R E R - - - - - - - - - - - | | |
| pG3834 (1227) | | | |
| pG1455 (1228) | E M Q E K E D I S S S S S W Q K Q K K S L V Q F S S V V I I | | |
| pG3805 (1229) | L W L P L S K G K G I S S M F L S G K W T - - - - - - - - - | | |
| pG958 (520) | - - M V D E Q G F R F Q D S F V L K K L G - - - - - - - - - | | |
| pG1924 (1230) | - - - - A A M G H G Q G V Y | | |
| pG518 (612) | - - - - V A K M K L K Q I S L V A K R Y Y - - - - - - - - - | | |
| pG3808 (1231) | A W I I T T R P S G P I E I F I H H H | | |
| pG3833 (1232) | | | |
| pG523 (1233) | | | |
| pG514 (1234) | | | |
| pG3806 (1235) | | | |
| pG526 (1236) | | | |
| pG1454 (954) | D G L F R T T S Y Q L P G L N W Y S S | | |

Fig. 18Z

| Sequence Name (SEQ ID NO.) | 790 | 800 | 810 |
|---|---|---|---|
| G3809 (1012) | | | |
| pG3807 (1222) | | | |
| pG521 (1223) | | | |
| pG3041 (690) | M C F W V L L L S V S F K V S I L V S S R | | |
| pG3832 (1224) | | | |
| pG515 (20) | | | |
| pG2053 (10) | | | |
| pG516 (22) | | | |
| pG517 (24) | | | |
| pG513 (1225) | - - - - - - - - - V V A V V C V M S V C S L V A | | |
| pG960 (1226) | - - - - - - - - - - - - - - - - - I K C S L M | | |
| pG3834 (1227) | | | |
| pG1455 (1228) | V A V I V V L V E I W K E S R D A K C S F L F H Q L D S F K | | |
| pG3805 (1229) | - - - - - - - F L T S A L A I S T P A E C D H | | |
| pG958 (520) | - - - - - - - L S L A I I L A V S T I S L I | | |
| pG1924 (1230) | | | |
| pG518 (612) | - - - - - - - K C L T I I F | | |
| pG3808 (1231) | | | |
| pG3833 (1232) | | | |
| pG523 (1233) | | | |
| pG514 (1234) | | | |
| pG3806 (1235) | | | |
| pG526 (1236) | | | |
| pG1454 (954) | | | |

Fig. 18AA

| Sequence Name (SEQ ID NO.) | 820 | 830 | 840 |
|---|---|---|---|
| G3809 (1012) | | | |
| pG3807 (1222) | | | |
| pG521 (1223) | | | |
| pG3041 (690) | | | |
| pG3832 (1224) | | | |
| pG515 (20) | | | |
| pG2053 (10) | | | |
| pG516 (22) | | | |
| pG517 (24) | | | |
| pG513 (1225) | | | |
| pG960 (1226) | | | |
| pG3834 (1227) | | | |
| pG1455 (1228) | G M F T | | |
| pG3805 (1229) | | | |
| pG958 (520) | | | |
| pG1924 (1230) | | | |
| pG518 (612) | | | |
| pG3808 (1231) | | | |
| pG3833 (1232) | | | |
| pG523 (1233) | | | |
| pG514 (1234) | | | |
| pG3806 (1235) | | | |
| pG526 (1236) | | | |
| pG1454 (954) | | | |

Fig. 18BB

| Sequence Name (SEQ ID NO.) | | | Sequence (positions 1-40+) |
|---|---|---|---|
| G2311 | (1242) | A.thaliana | LK----------------------------------------WTA |
| G214 | (1243) | A.thaliana | ER----------------------------------------WTE |
| G1816 | (1244) | A.thaliana | IN----------------------------------------MTE |
| CPC | (1237) | A.thaliana | VK----------------------------------------MSE |
| G226 | (1245) | A.thaliana | IS----------------------------------------MTE |
| G3450 | (1246) | G.max | IH----------------------------------------MSE |
| G2718 | (1247) | A.thaliana | IA----------------------------------------MAQ |
| G682 | (1248) | A.thaliana | VN----------------------------------------MSQ |
| G3392 | (1249) | O.sativa | VH----------------------------------------FTE |
| G3393 | (1250) | O.sativa | VH----------------------------------------FTE |
| G3431 | (1251) | Z.mays | VD----------------------------------------FTE |
| G3444 | (1252) | Z.mays | VD----------------------------------------FTE |
| G3448 | (1253) | G.max | VE----------------------------------------FSE |
| G3449 | (1254) | G.max | VE----------------------------------------FSE |
| G3446 | (1255) | G.max | VE----------------------------------------FSE |
| G3447 | (1256) | G.max | VE----------------------------------------FSE |
| G3445 | (1257) | G.max | VE----------------------------------------FSE |
| G1332 | (1258) | A.thaliana | VETHGEGNWADISRRSGLKRGGKSCRLRWKNYLRPNIKRGSMSP |
| G676 | (1238) | A.thaliana | VKAHGKGHWNRIAKKTGLKRCGKSCRLRWMNYLSPNVKRGNFTE |
| G211 | (1239) | A.thaliana | IKKEGEGRWRSLPKRAGLLRCGKSCRLRWMNYLRPSVKRGGITS |
| G669 | (1240) | A.thaliana | ITTHGEGKWSTLPNQAGLKRCGKSCRLRWKNYLRPGIKRGNISS |
| G663 | (1241) | A.thaliana | IDKYGEGKWHQVPLRAGLNRCRKSCRLRWLNYLKPSIKRGRLSN |
| Clade Consensus | (1259) | | VE                                        FSE |

FIG. 20A

| Sequence Name (SEQ ID NO.) | | | 50          60          70          80 |
|---|---|---|---|
| G2311 | (1242) | A.thaliana | EEEEALLAGIRKHGPGKWKNILRDPEFADQLIHRSNIDLKDKWR |
| G214  | (1243) | A.thaliana | EEHNRFIEALRLYGR-AWQKIEEHVAT-KTAVQIRSHAQKFFSK |
| G1816 | (1244) | A.thaliana | QE-EDLIFRMYRLVGDRWDLIAGRVPG-RQPEEIERYWIMRN-- |
| CPC   | (1237) | A.thaliana | EE-EDLISRMYKLVGDRWELIAGRIPG-RTPEEIERYWLMKH-- |
| G226  | (1245) | A.thaliana | QE-EDLISRMYRLVGNRWDLIAGRVVG-RKANEIERYWIMRN-- |
| G3450 | (1246) | G.max      | QE-EDLIRRMYKLVGDKWNLIAGRIPG-RKAEEIERFWIMRH-- |
| G2718 | (1247) | A.thaliana | EE-EDLICRMYKLVGERWDLIAGRIPG-RTAEEIERFWVMKN-- |
| G682  | (1248) | A.thaliana | EE-EDLVSRMHKLVGDRWELIAGRIPG-RTAGEIERFWVMKN-- |
| G3392 | (1249) | O.sativa   | EE-EDIVFRMHRLVGNRWELIAGRIPG-RTAEEVEKFWAIKH-- |
| G3393 | (1250) | O.sativa   | EE-EDLVFRMHRLVGNRWELIAGRIPG-RTAKEVEMFWAVKH-- |
| G3431 | (1251) | Z.mays     | AE-EDLVSRMHRLVGNRWEIIAGRIPG-RTAEEVEMFWSKKY-- |
| G3444 | (1252) | Z.mays     | AE-EDLVSRMHRLVGNRWEIIAGRIPG-RTAEEVEMFWAIKH-- |
| G682  | (1248) | G.max      | DE-ETLIIRMYKLVGERWSIIAGRIPG-RTAEEIEKYWTSRF-- |
| G3449 | (1254) | G.max      | DE-ETLIIRMYKLVGERWSLIAGRIPG-RTAEEIEKYWTSRF-- |
| G3446 | (1255) | G.max      | AE-EILIAMVYNLVGERWSLIAGRIPG-RTAEEIEKYWTSRF-- |
| G3447 | (1256) | G.max      | AE-EILIAMVYNLVGERWSLIAGRIPG-RTAEEIEKYWTSRF-- |
| G3445 | (1257) | G.max      | AE-EILIAMVYNLVGERWSLIAGRIPG-RTAEEIEKYWTSRF-- |
| G1332 | (1258) | A.thaliana | QE-QDLIIRMHKLLGNRWSLIAGRLPG-RTDNEVKNYWNTHL-- |
| G676  | (1238) | A.thaliana | QE-EDLIIRLHKLLGNRWSLIAKRVPG-RTDNQVKNYWNTHL-- |
| G211  | (1239) | A.thaliana | DE-EDLILRLHRLLGNRWSLIAGRIPG-RTDNEIKNYWNTHL-- |
| G669  | (1240) | A.thaliana | DE-EELIIRLHNLLGNRWSLIAGRLPG-RTDNEIKNHWNSNL-- |
| G663  | (1241) | A.thaliana | DE-VDLLLRLHKLLGNRWSLIAGRLPG-RTANDVKNYWNTHL-- |
| Clade Consensus | (1259) | | -E-EDLISRMY-LVGERWELIAGRIPG-RTAEEIE-YWTMR--- |

FIG. 20B

PLANT TRANSCRIPTIONAL REGULATORS

CROSS-REFERENCE TO RELATED APPLICATIONS

This application is a division of U.S. patent application Ser. No. 14/167,768, filed Jan. 29, 2014, and is a divisional of U.S. patent application Ser. No. 12/705,845, filed Feb. 15, 2010 (now U.S. Pat. No. 8,686,226). Application Ser. No. 12/705,845 is a continuation-in-part of U.S. patent application Ser. No. 11/435,388, filed May 15, 2006 (now U.S. Pat. No. 7,663,025), which is a continuation-in-part of PCT patent application PCT/US2004/037584, filed Nov. 12, 2004 (expired). PCT/US2004/037584 is a continuation-in-part of U.S. patent application Ser. No. 10/714,887, filed Nov. 13, 2003 (abandoned). PCT/US2004/037584 also claims the benefit of U.S. provisional patent application 60/542,928, filed Feb. 5, 2004. PCT/US2004/037584 also claims the benefit of U.S. provisional patent application 60/527,658, filed Dec. 5, 2003. U.S. patent application Ser. No. 12/705,845, filed Feb. 15, 2010 is a continuation-in-part of U.S. patent application Ser. No. 10/714,887, filed Nov. 13, 2003 (abandoned), which is a continuation-in-part of U.S. patent application Ser. No. 10/412,699, filed Apr. 10, 2003 (issued as U.S. Pat. No. 7,345,217). U.S. patent application Ser. No. 10/412,699 is a continuation-in-part of U.S. patent application Ser. No. 09/506,720, filed Feb. 17, 2000 (abandoned), which claims the benefit of U.S. provisional patent application 60/135,134, filed May 20, 1999. U.S. patent application Ser. No. 10/412,699 is a continuation-in-part of U.S. patent application Ser. No. 09/394,519, filed Sep. 13, 1999 (abandoned). U.S. patent application Ser. No. 10/412,699 is also a continuation-in-part of U.S. patent application Ser. No. 09/533,392, filed Mar. 22, 2000 (abandoned). U.S. patent application Ser. No. 10/412,699 is also a continuation-in-part of U.S. patent application Ser. No. 09/533,029, filed Mar. 22, 2000 (issued as U.S. Pat. No. 6,664,446). U.S. patent application Ser. No. 10/412,699 is also a continuation-in-part of U.S. patent application Ser. No. 09/532,591, filed Mar. 22, 2000 (abandoned). U.S. patent application Ser. No. 10/412,699 is also a continuation-in-part of U.S. patent application Ser. No. 09/533,030, filed Mar. 22, 2000 (abandoned), which claims the benefit of U.S. provisional patent application 60/125,814, filed Mar. 23, 1999. U.S. patent application Ser. No. 10/412,699 is a continuation-in-part of U.S. patent application Ser. No. 09/713,994, filed Nov. 16, 2000 (abandoned), which claims the benefit of U.S. provisional patent application 60/166,228, filed Nov. 17, 1999. U.S. patent application Ser. No. 09/713,994 also claims the benefit of U.S. provisional patent application 60/197,899, filed Apr. 17, 2000, and U.S. patent application Ser. No. 09/713,994 claims the benefit of U.S. provisional patent application 60/227,439, filed Aug. 22, 2000. U.S. patent application Ser. No. 10/714,887 (MBI-0058CIP, abandoned) is a continuation-in-part of U.S. patent application Ser. No. 10/456,882, filed Jun. 6, 2003 (abandoned). U.S. patent application Ser. No. 10/714,887 is also a continuation-in-part of U.S. patent application Ser. No. 09/823,676, filed Mar. 30, 2001 (issued as U.S. Pat. No. 6,717,034). U.S. patent application Ser. No. 10/714,887 is a continuation-in-part of U.S. patent application Ser. No. 09/934,455, filed Aug. 22, 2001 (abandoned). U.S. patent application Ser. No. 10/714,887 is a continuation-in-part of U.S. patent application Ser. No. 10/112,887, filed Mar. 18, 2002 (abandoned). U.S. patent application Ser. No. 10/714,887 is a continuation-in-part of U.S. patent application Ser. No. 10/286,264, filed Nov. 1, 2002 (abandoned). U.S. patent application Ser. No. 10/714,887 is a continuation-in-part of U.S. patent application Ser. No. 10/225,066, filed Aug. 9, 2002 (issued as U.S. Pat. No. 7,238,860). U.S. patent application Ser. No. 10/714,887 is a continuation-in-part of U.S. patent application Ser. No. 10/225,067, filed Aug. 9, 2002 (issued as U.S. Pat. No. 7,135,616). U.S. patent application Ser. No. 10/714,887 is a continuation-in-part of U.S. patent application Ser. No. 10/225,068, filed Aug. 9, 2002 (issued as U.S. Pat. No. 7,193,129). U.S. patent application Ser. No. 10/225,068 claims the benefit of U.S. provisional patent application 60/310,847, filed Aug. 9, 2001. U.S. patent application Ser. No. 10/225,068 also claims the benefit of U.S. provisional patent application 60/338,692, filed Dec. 11, 2001. U.S. patent application Ser. No. 10/225,068 also claims the benefit of U.S. provisional patent application 60/336,049, filed Nov. 19, 2001. U.S. patent application Ser. No. 10/714,887 is a continuation-in-part of U.S. patent application Ser. No. 10/302,267, filed Nov. 22, 2002 (issued as U.S. Pat. No. 7,223,904). U.S. patent application Ser. No. 10/714,887 is also a continuation-in-part of U.S. patent application Ser. No. 10/374,780, filed Feb. 25, 2003 (issued as U.S. Pat. No. 7,511,190). U.S. patent application Ser. No. 10/374,780 is a continuation-in-part of U.S. patent application Ser. No. 09/837,944, filed Apr. 18, 2001 (abandoned). U.S. patent application Ser. No. 10/374,780 is a continuation-in-part of U.S. patent application Ser. No. 10/171,468, filed Jun. 14, 2002 (abandoned). U.S. patent application Ser. No. 10/714,887 is a continuation-in-part of U.S. patent application Ser. No. 10/666,642, filed Sep. 18, 2003 (issued as U.S. Pat. No. 7,196,245), which claims the benefit of U.S. provisional patent application 60/434,166, filed Dec. 17, 2002. U.S. patent application Ser. No. 10/666,642 also claims the benefit of U.S. provisional patent application 60/411,837, filed Sep. 18, 2002. U.S. patent application Ser. No. 10/666,642 also claims the benefit of U.S. provisional patent application 60/465,809, filed Apr. 24, 2003. Patent application Ser. No. 12/705,845 is a continuation-in-part of U.S. patent application Ser. No. 11/981,576, filed Oct. 30, 2007 (now U.S. Pat. No. 7,888,558), and U.S. patent application Ser. No. 11/981,576 is a continuation-in-part of US patent application U.S. patent application Ser. No. 10/456,882, filed Jun. 6, 2003 (abandoned). All of these applications are hereby incorporated by reference in their entirety.

JOINT RESEARCH AGREEMENT

The claimed invention, in the field of functional genomics and the characterization of plant genes for the improvement of plants, was made by or on behalf of Mendel Biotechnology, Inc. and Monsanto Company as a result of activities undertaken within the scope of a joint research agreement in effect on or before the date the claimed invention was made.

FIELD OF THE INVENTION

The present invention relates to compositions and methods for modifying the phenotype of a plant, including altered carbon/nitrogen balance sensing, improved nitrogen uptake or assimilation efficiency, improved growth or survival of plants under conditions of nitrogen limitation, increased tolerance to drought or other abiotic stress, and/or increased tolerance to shade.

BACKGROUND OF THE INVENTION

A plant's traits may be controlled through a number of cellular processes. One important way to manipulate that control is through transcription factors—proteins that influence the expression of a particular gene or sets of genes. Because transcription factors are key controlling elements of biological pathways, altering the expression levels of one or more transcription factors can change entire biological pathways in an organism. Strategies for manipulating a plant's biochemical, developmental, or phenotypic characteristics by altering a transcription factor expression can result in plants and crops with new and/or improved commercially valuable properties, including traits that improve yield or survival and yield during periods of abiotic stress, improve shade tolerance, or alter a plant's sensing of its carbon/nitrogen balance.

We have identified numerous polynucleotides encoding transcription factors, functionally related sequences listed in the Sequence Listing, and structurally and functionally similar sequences, developed numerous transgenic plants using these polynucleotides, and analyzed the plants for their tolerance to shade, drought stress, and altered carbon-nitrogen balance (C/N) sensing. In so doing, we have identified important polynucleotide and polypeptide sequences for producing commercially valuable plants and crops as well as the methods for making them and using them. The present invention thus relates to methods and compositions for producing transgenic plants with improved tolerance to drought and other abiotic stresses, with altered C/N sensing, and/or with improved tolerance to shade. This provides significant value in that the plants may thrive in hostile environments where low nutrient, light, or water availability limits or prevents growth of non-transgenic plants. Other aspects and embodiments of the invention are described below and can be derived from the teachings of this disclosure as a whole.

SUMMARY OF THE INVENTION

The present method is directed to recombinant polynucleotides that confer abiotic stress tolerance in plants when the expression of any of these recombinant polynucleotides is altered (e.g., by overexpression). Related sequences that are encompassed by the invention include nucleotide sequences that hybridize to the complement of the sequences of the invention under stringent conditions.

Related sequences that are also encompassed by the invention include polypeptide sequences within a given clade or subclade, that is, sequences that are evolutionarily, functionally and structurally related. The invention also pertains to a transgenic plant that comprises a recombinant polynucleotide that encodes a polypeptide that regulates transcription.

The invention also includes a transgenic plant that overexpresses a recombinant polynucleotide comprising a nucleotide sequence that hybridizes to the complement of any polynucleotide of the invention under stringent conditions. This transgenic plant has increased drought, low nitrogen and/or shade tolerance as compared to a wild-type or non-transformed plant of the same species that does not overexpress a polypeptide encoded by the recombinant polynucleotide.

The invention also encompasses a method for producing a transgenic plant having increased tolerance to drought, low nitrogen, and/or shade. These method steps include first providing an expression vector that contains a nucleotide sequence that hybridizes to the complement of a polynucleotide of the invention under stringent hybridization conditions. The expression vector is then introduced into a plant cell, the plant cell is cultured, from which a plant is generated. Due to the presence of the expression vector in the plant, the polypeptide encoded by the nucleotide sequence is overexpressed. This polypeptide has the property of regulating drought, low nitrogen, or shade tolerance in a plant, compared to a control plant that does not overexpress the polypeptide. After the drought, low nitrogen, or shade-tolerant transgenic plant is produced, it may be identified by comparing it with one or more non-transformed plants that do not overexpress the polypeptide. These method steps may further include selfing or crossing the abiotic stress-tolerant plant with itself or another plant, respectively, to produce seed. "Selfing" refers to self-pollinating, or using pollen from one plant to fertilize the same plant or another plant in the same line, whereas "crossing" generally refers to cross pollination with plant from a different line, such as a non-transformed or wild-type plant, or another transformed plant from a different transgenic line of plants. Crossing provides the advantage of being able to produce new varieties. The resulting seed may then be used to grow a progeny plant that is transgenic and has increased tolerance to abiotic stress.

The invention is also directed to a method for increasing a plant's tolerance to drought, low nitrogen, or shade. This method includes first providing a vector that comprises (i) regulatory elements effective in controlling expression of a polynucleotide sequence in a target plant, where the regulatory elements flank the polynucleotide sequence; and (ii) the polynucleotide sequence itself, which encodes a polypeptide that has the ability to regulate drought, low nitrogen, or shade tolerance in a plant, as compared to a control plant of the same species that does not overexpress the polypeptide. The plant is transformed with the vector in order to generate a transformed plant with increased tolerance to drought, low nitrogen, or shade.

BRIEF DESCRIPTION OF THE SEQUENCE LISTING AND FIGURES

The Sequence Listing provides exemplary polynucleotide and polypeptide sequences of the invention. The traits associated with the use of the sequences are included in the Examples.

Incorporation of the Sequence Listing. The copy of the Sequence Listing, being submitted electronically with this patent application, provided under 37 C.F.R §1.821-1.825, is a read-only memory computer-readable file in ASCII text format. The Sequence Listing is named "MDBT008USD2-sequence_listing_replacement.txt", the electronic file of the Sequence Listing was created on Jul. 27, 2015, and is 2,500,656 bytes in size (or 2,500 kilobytes in size as measured in MS-WINDOWS). The Sequence Listing is herein incorporated by reference in its entirety.

Figures. For figures presenting one or more sequences, the SEQ ID NO: of the sequence(s) is/are provided in parentheses.

FIG. 1 shows a conservative estimate of phylogenetic relationships among the orders of flowering plants (modified from Angiosperm Phylogeny Group (1998) Ann. Missouri Bot. Gard. 84: 1-49). Those plants with a single cotyledon (monocots) are a monophyletic clade nested within at least two major lineages of dicots; the eudicots are further divided into rosids and asterids. *Arabidopsis* is a rosid eudicot classified within the order Brassicales; rice is a member of the monocot order Poales. FIG. 1 was adapted from Daly et al. (2001) Plant Physiol. 127: 1328-1333.

Figure 2:
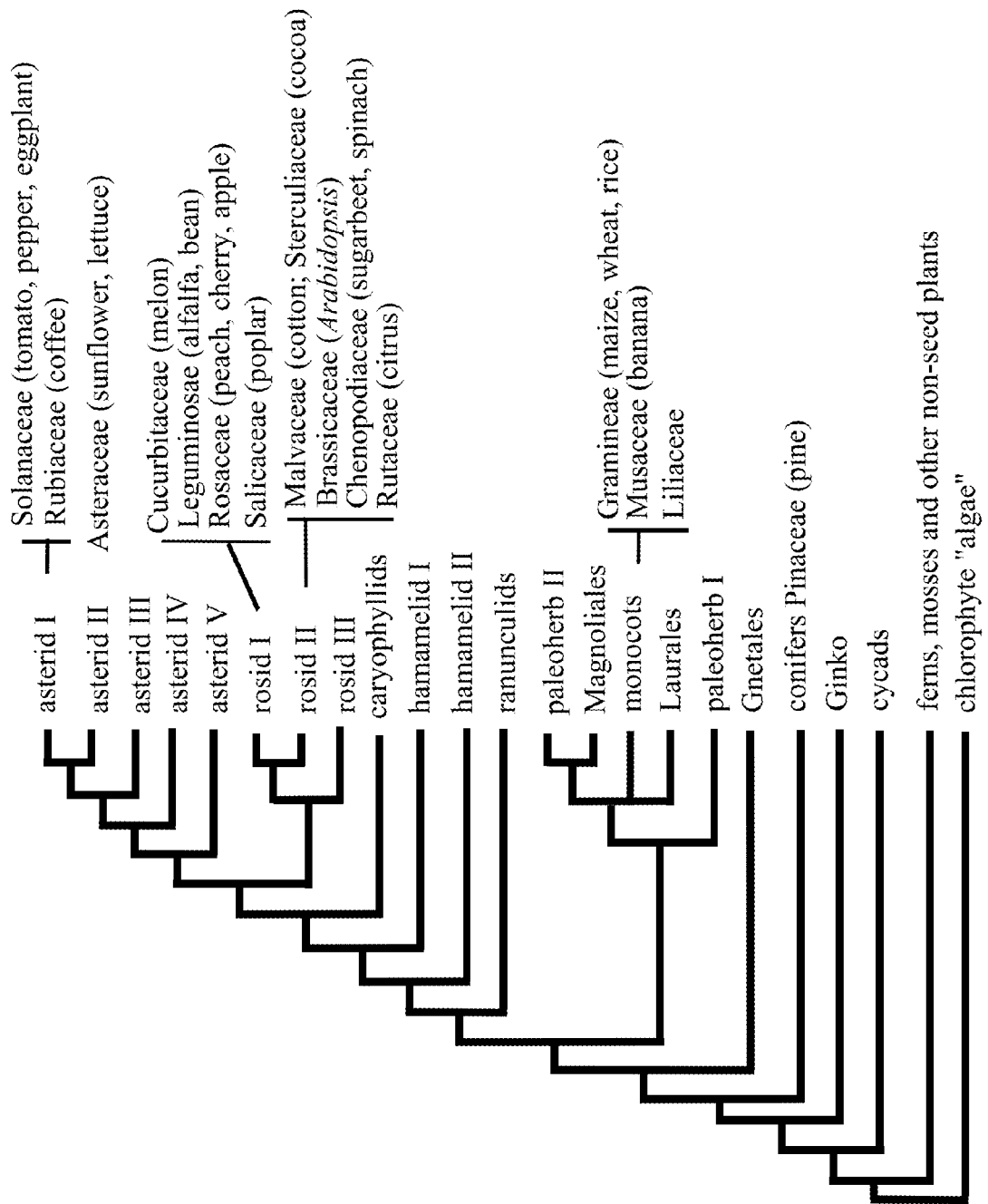

FIG. 2 shows a phylogenic dendogram depicting phylogenetic relationships of higher plant taxa, including clades containing tomato and *Arabidopsis*; adapted from Ku et al. (2000) Proc. Natl. Acad. Sci. 97: 9121-9126; and Chase et al. (1993) Ann. Missouri Bot. Gard. 80: 528-580.

FIG. 3 is a multiple amino acid sequence alignment of subsequence within the AP2 domain of G47, G2133 and their orthologs. The first column shows the sequence name followed by the SEQ ID No. in parentheses. Clade orthologs and paralogs are indicated by the black bar on the left side of the figure. Of the sequences examined to date, two valine residues were found that are present in members of the G47 clade but not outside of the clade (arrows). Residues that may be used to identify a G47 clade member are indicated by the residues shown in the boxes in FIG. 3

Figure 4:
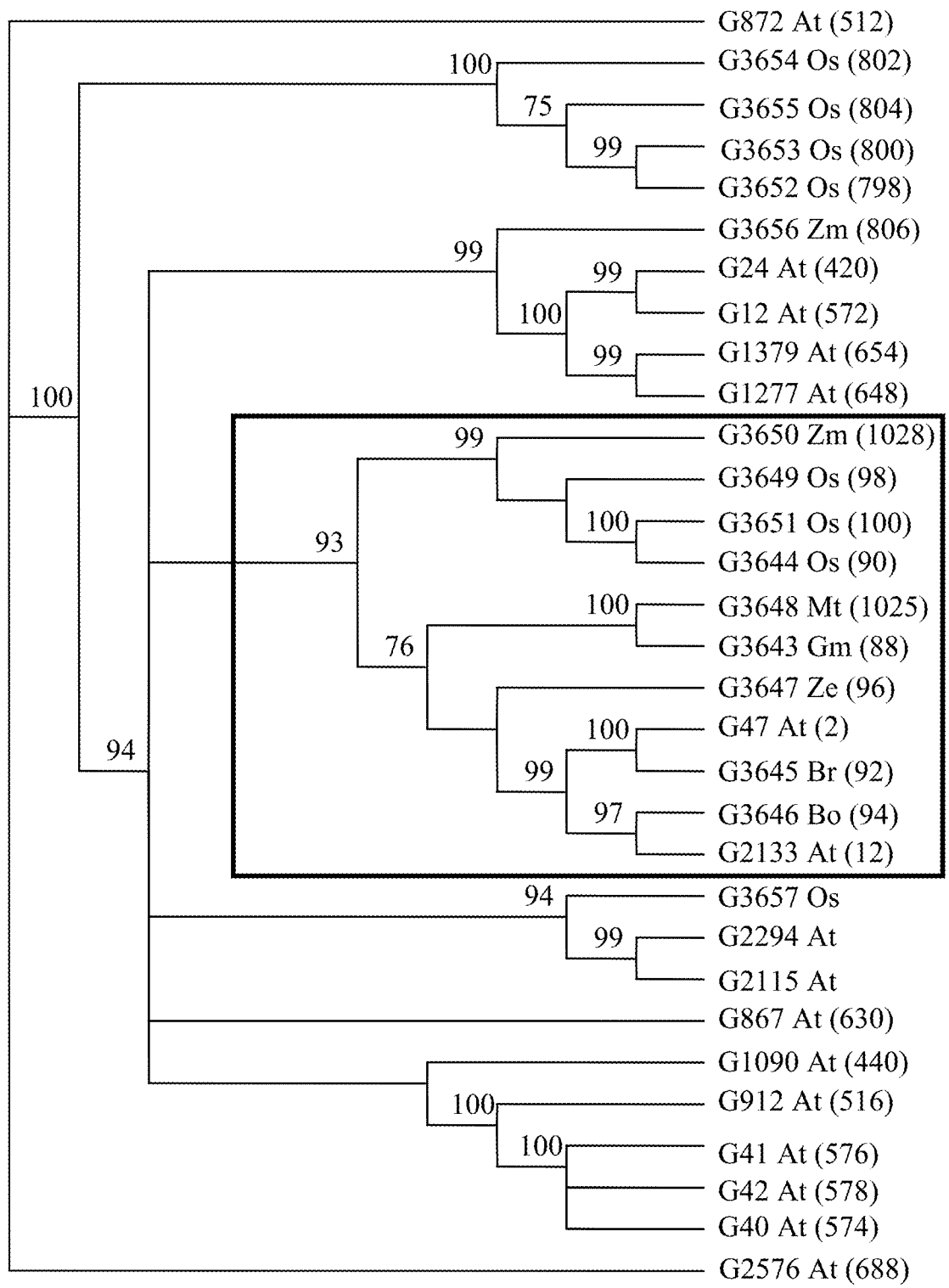

FIG. 4 illustrates the relationship of G47 and related sequences in this phylogenetic tree of the G47 clade and similar sequences. The tree building method used was "Neighbor Joining" with "Systematic Tie-Breaking" and Bootstrapping with 1000 replicates (Uncorrected ("p"), with gaps distributed proportionally). Full-length polypeptides were used to build the phylogeny as defined in FIG. 4. The members of the clade shown within the box are predicted to contain functional homologs of G47. Abbreviations: At *Arabidopsis thaliana*; Os *Oryza sativa*; Zm *Zea mays*; Gm *Glycine max*; Mt *Medicago truncatula*; Br *Brassica rapa*; Bo *Brassica oleracea*; Ze: *Zinnia elegans*.

Figure 5A:
Figure 5B:
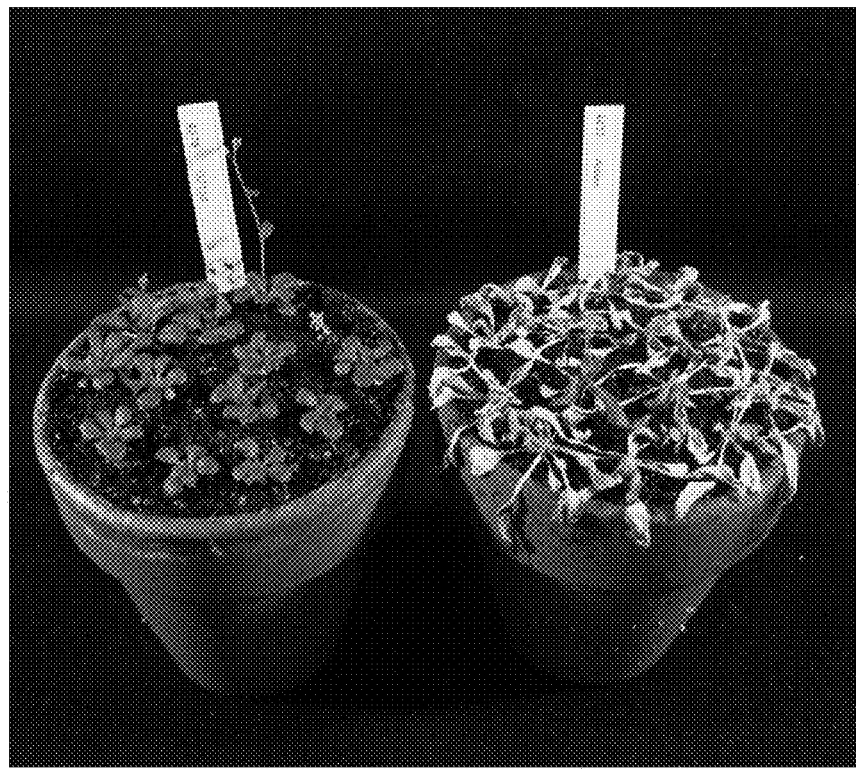

FIGS. 5A and 5B compare the recovery from a drought treatment of wild-type controls and two lines of *Arabidopsis* plants overexpressing G2133, a paralog of G47. FIGS. 5A and 5B show two 35S::G2133 lines of plants (one line in each figure) in the pot on the left of each figure and control plants on the right of each figure. Each pot contained several plants grown under 24 hours light. All were deprived of water for eight days, and are shown after re-watering. All of the plants of the G2133 overexpressor lines recovered, and all of the control plants were either dead or severely and adversely affected by the drought treatment.

FIGS. 6A-6C compare a number of homeodomains from the zinc-finger-homeodomain-type (ZF-HD) proteins related to G2999. The first column shows the sequence name followed by the SEQ ID No. in parentheses. Homeodomains from the ZF-HD type proteins are distinct from classical types of homeodomains and lie on the distinct branch of the tree shown in FIG. 7. The relationships established from this type of alignment of homeodomains were used to generate the phylogenetic tree shown in FIGS. 7 and 8. Residues that may be used to identify the G2999 clade are shown in boxes in FIGS. 6A and 6B.

Figure 7:
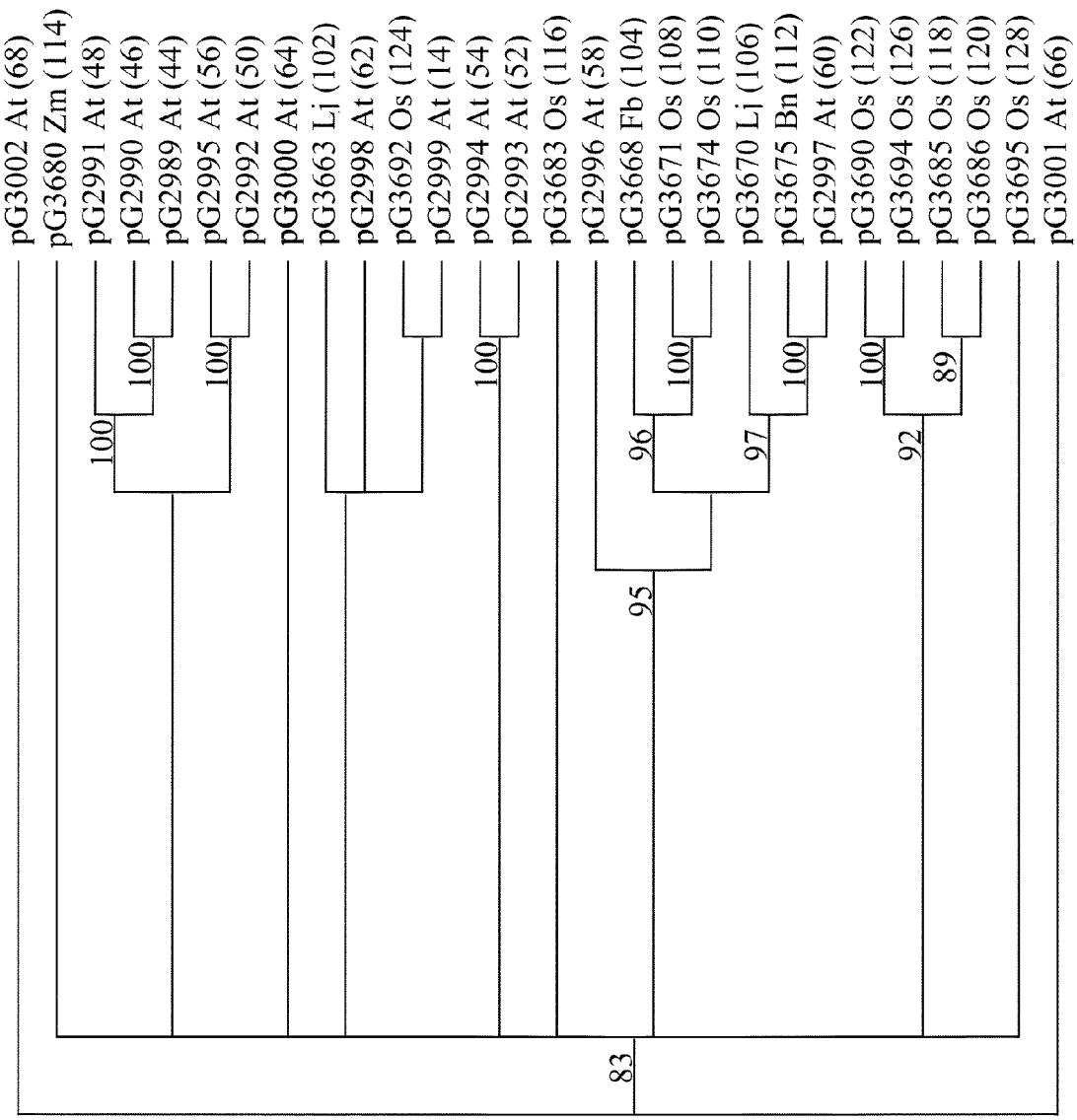

FIG. 7 illustrates the relationship of G2999 and related sequences in this phylogenetic tree of the G2999 clade and similar sequences comprising ZF-HD-type proteins. The tree building method used was "Neighbor Joining" with "Systematic Tie-Breaking" and Bootstrapping with 1000 replicates (Uncorrected ("p"), with gaps distributed proportionally. All of the sequences shown are members of the clade and are predicted to be functional homologs of G2999. Abbreviations: At *Arabidopsis thaliana*; Os (jap) *Oryza sativa* (*japonica* cultivar group); Os (ind) *Oryza sativa* (indica cultivar group); Zm *Zea mays*; Lj *Lotus corniculatus* var. *japonicus*; Bn *Brassica napus*; Fb *Flaveria bidentis*.

Figure 8:
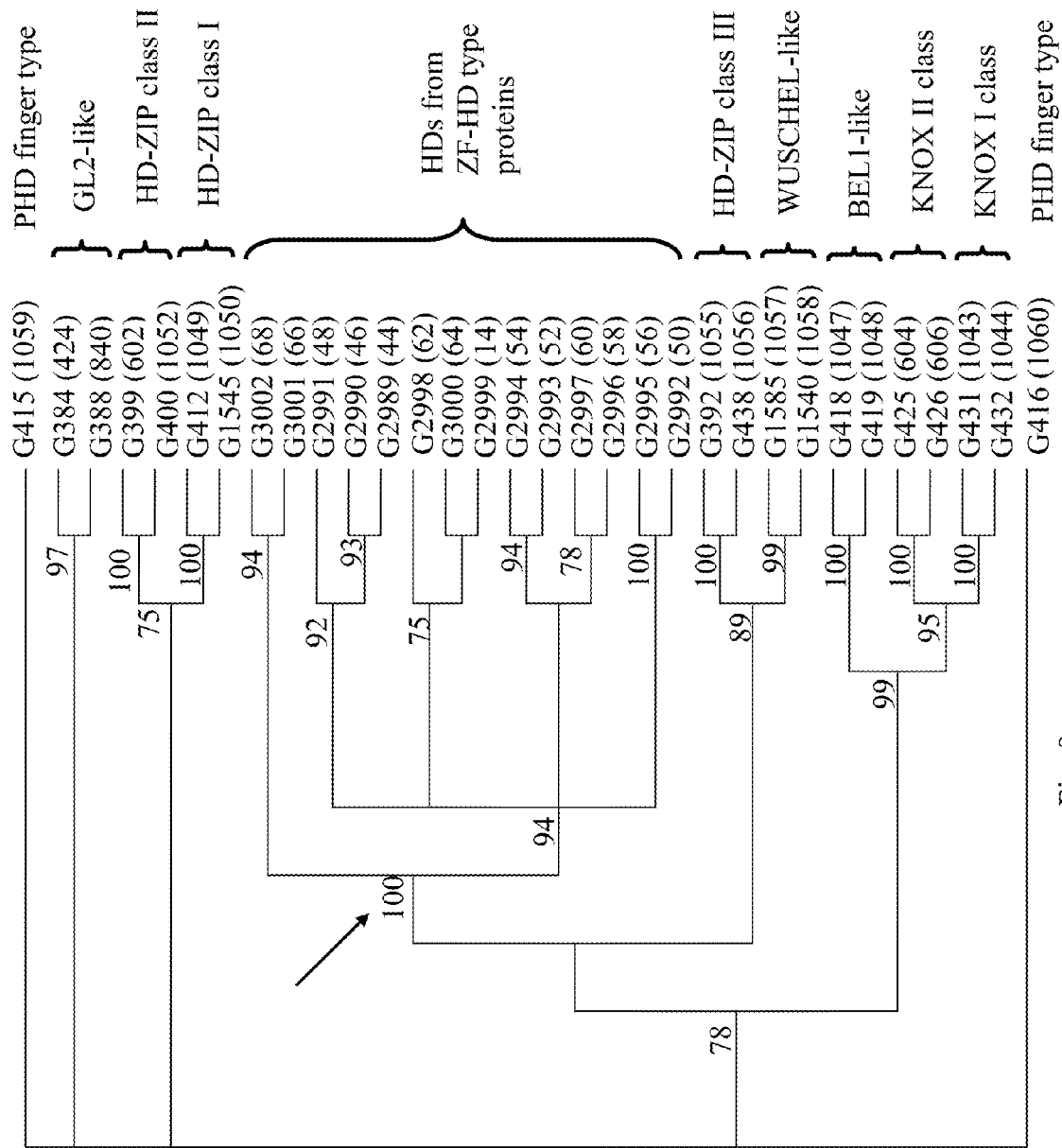

FIG. 8 is a phylogenetic tree (neighbor-joining, 1000 bootstraps) highlighting the relational differences between the ZF-HD type proteins and the "classical" homeodomain (HD) proteins. The homeodomains from ZF-HD type proteins lie on a distinct branch of the tree compared to classical types of homeodomains (arrow).

FIGS. 9A-9L represent a multiple amino acid sequence alignment of G1792 orthologs and paralogs. The first column shows the sequence name followed by the SEQ ID No. in parentheses. Clade orthologs and paralogs are indicated by the black bar on the left side of the figure. Conserved regions of identity are boxed and bolded while conserved sequences of similarity are boxed with no bolding. The AP2 conserved domains span alignment coordinates 196-254. The S conserved domain spans alignment coordinates of 301-304. The EDLL conserved domain spans the alignment coordinates of 393-406 (also see FIG. 10). Abbreviations: At *Arabidopsis thaliana*; Os *Oryza sativa*; Zm *Zea mays*; Ta *Triticum aestivum*; Gm *Glycine max*; Mt *Medicago truncatula*.

FIG. 10 shows a novel conserved domain for the G1792 clade, herein referred to as the "EDLL domain". The first column shows the sequence name followed by the SEQ ID No. in parentheses. All clade members contain a glutamic acid residue at position 3, an aspartic acid residue at position 8, and a leucine residue at positions 12 and 16. Abbreviations: At *Arabidopsis thaliana*; Os *Oryza sativa*; Zm *Zea mays*; Ta *Triticum aestivum*; Gm *Glycine max*; Mt *Medicago truncatula*.

Figure 11:
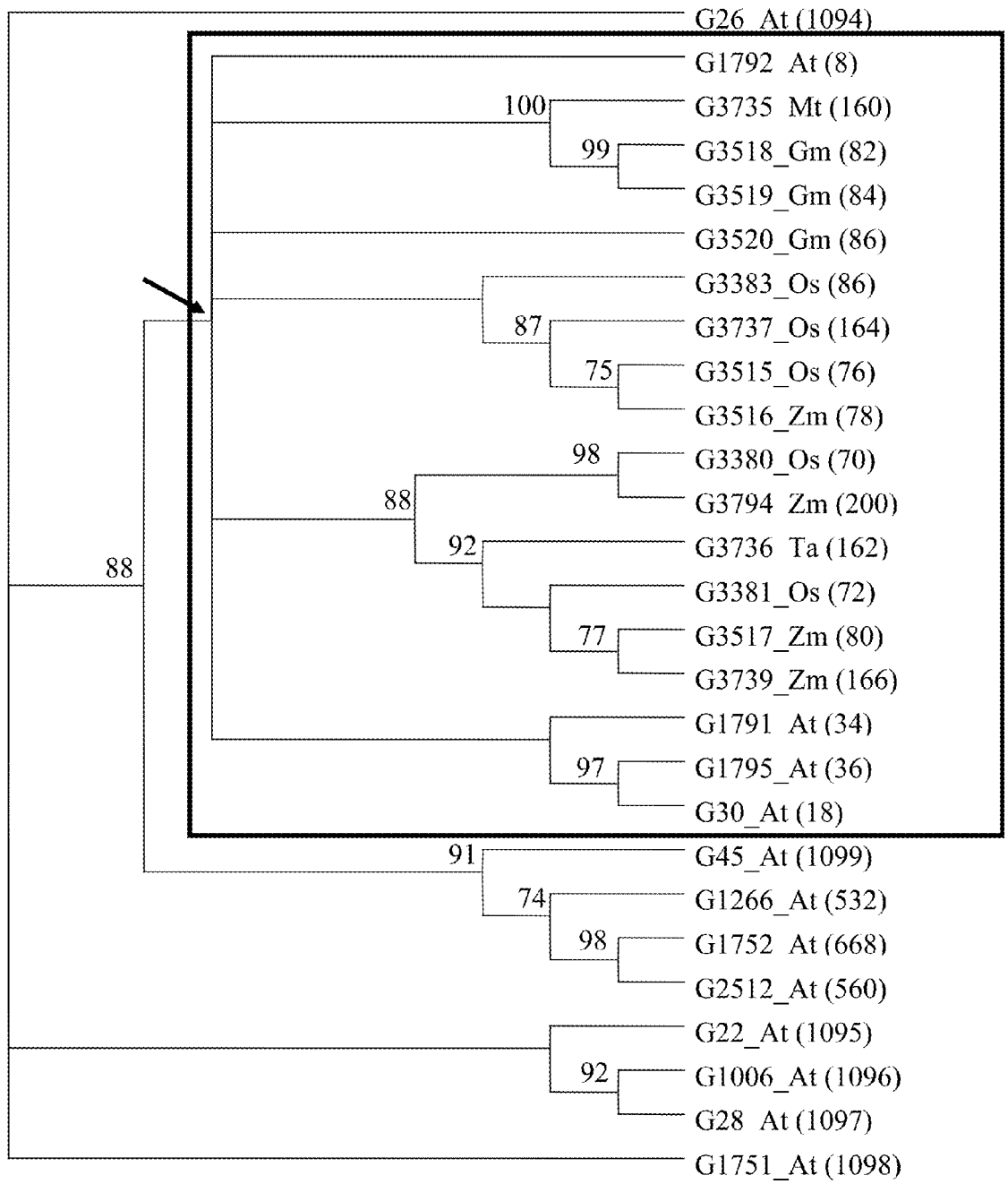

FIG. 11 illustrates the relationship of G1792 and related sequences in this phylogenetic tree of the G1792 clade of transcription factors. The tree building method used was "Neighbor Joining" with "Systematic Tie-Breaking" and Bootstrapping with 1000 replicates. Only conserved domains were used to build the phylogeny as defined in FIG. 11. The members of the G1792 clade are shown within the box. The sequences within the G1792 clade descend from a common ancestral node (arrow).

FIG. 12 shows an alignment of G3086, orthologs, and paralog subsequences. The first column shows the sequence name followed by the SEQ ID No. in parentheses. The G3086 clade is indicated by the black bar on the left side of the figure. Residues that may be used to identify clade members appear in boxes.

Figure 13:
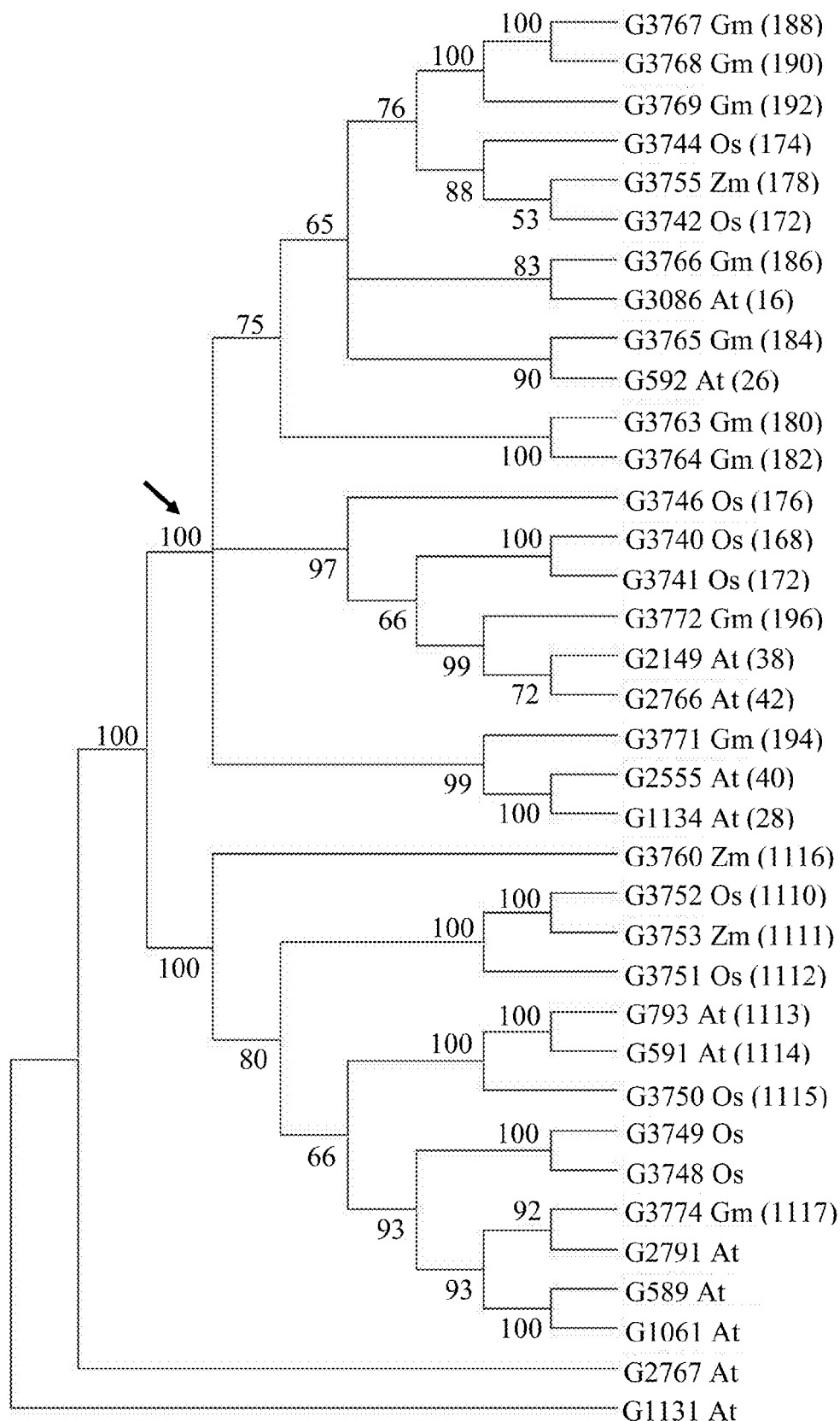

FIG. 13 is a phylogenetic tree of the G3086 clade, including G3086 and its paralogs and orthologs. Full length, predicted protein sequences were used to construct a pairwise comparison, bootstrapped (1000 replicates) neighbor-joining tree, consensus view. Sequences within the G3086 clade are located within the box. The sequences within the G3086 clade descend from a common ancestral node (arrow). Abbreviations: At *Arabidopsis thaliana*; Os *Oryza sativa*; Zm *Zea mays*; Gm *Glycine max*.

FIGS. 14A-14R show a multiple amino acid sequence alignment of G922 orthologs and paralogs. The first column shows the sequence name followed by the SEQ ID No. in parentheses. Clade orthologs and paralogs are indicated by black bar on left side of the figure. Residues that appear in boldface represent an acidic, ser/pro-rich domain that is unique to the G922 clade. Abbreviations: At *Arabidopsis thaliana*; Os *Oryza sativa*; Zm *Zea mays*; Ta *Triticum aestivum*; Gm *Glycine max*; Le *Lycopersicon esculentum*; Ps *Pisum sativum*.

Figure 15:
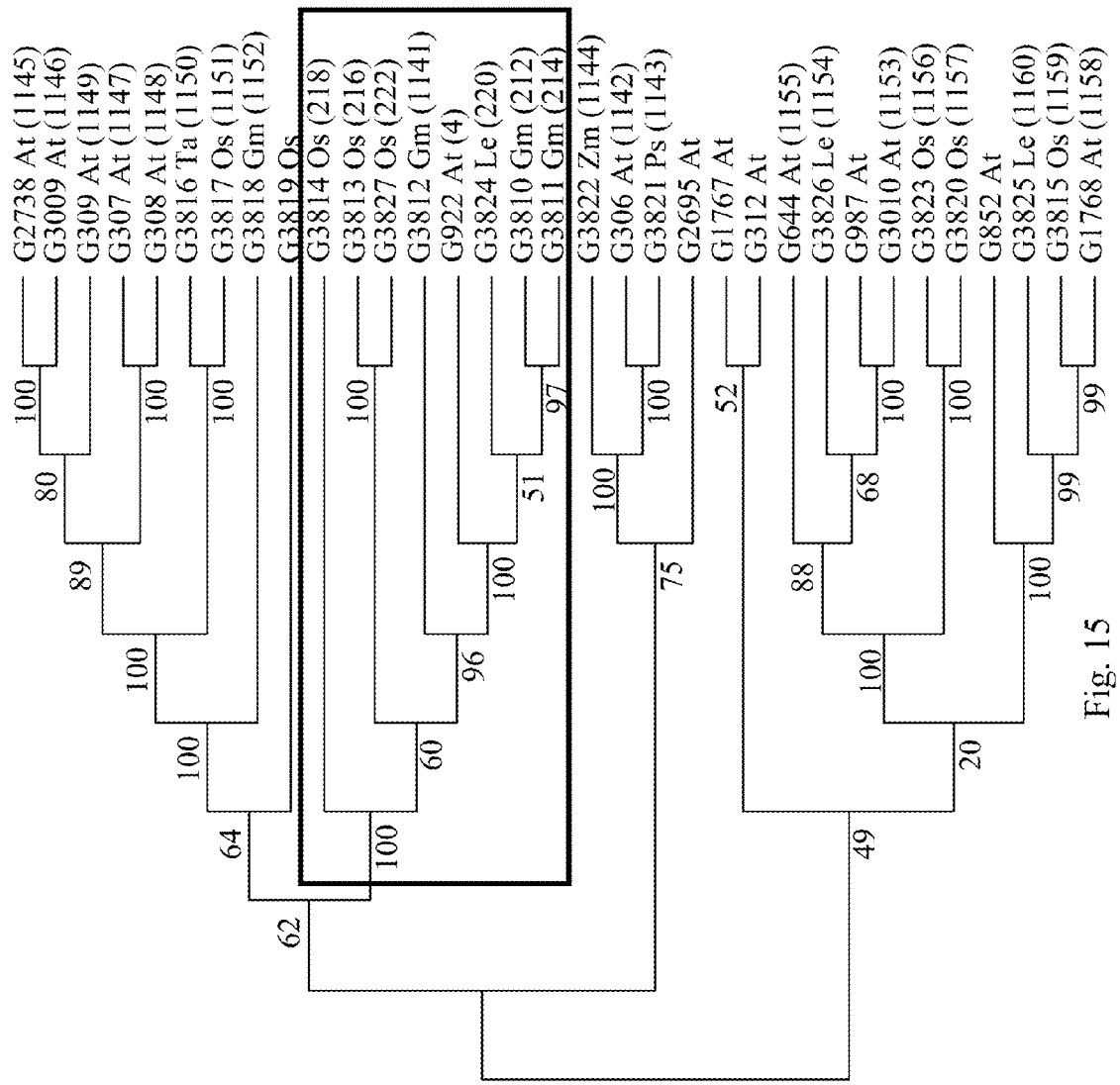

FIG. 15 is a phylogenetic tree of the G922 paralogs and orthologs. Full length, predicted protein sequences were used to construct a pairwise comparison, bootstrapped (1000 replicates) neighbor-joining tree, consensus view. Sequences within the G922 clade are located within the box.

FIG. 16 is a sequence alignment of predicted protein subsequences within the WRKY domain from G1274 paralogs and orthologs. The first column shows the sequence name followed by the SEQ ID No. in parentheses. The sequences within the G1274 clade are indicated by the black bar to the left of the sequences. Amino acid residues within the WRKY domain that distinguish the G1274 clade sequences, and are putatively responsible for conserved functionality, are indicated within the boxes.

Figure 17:
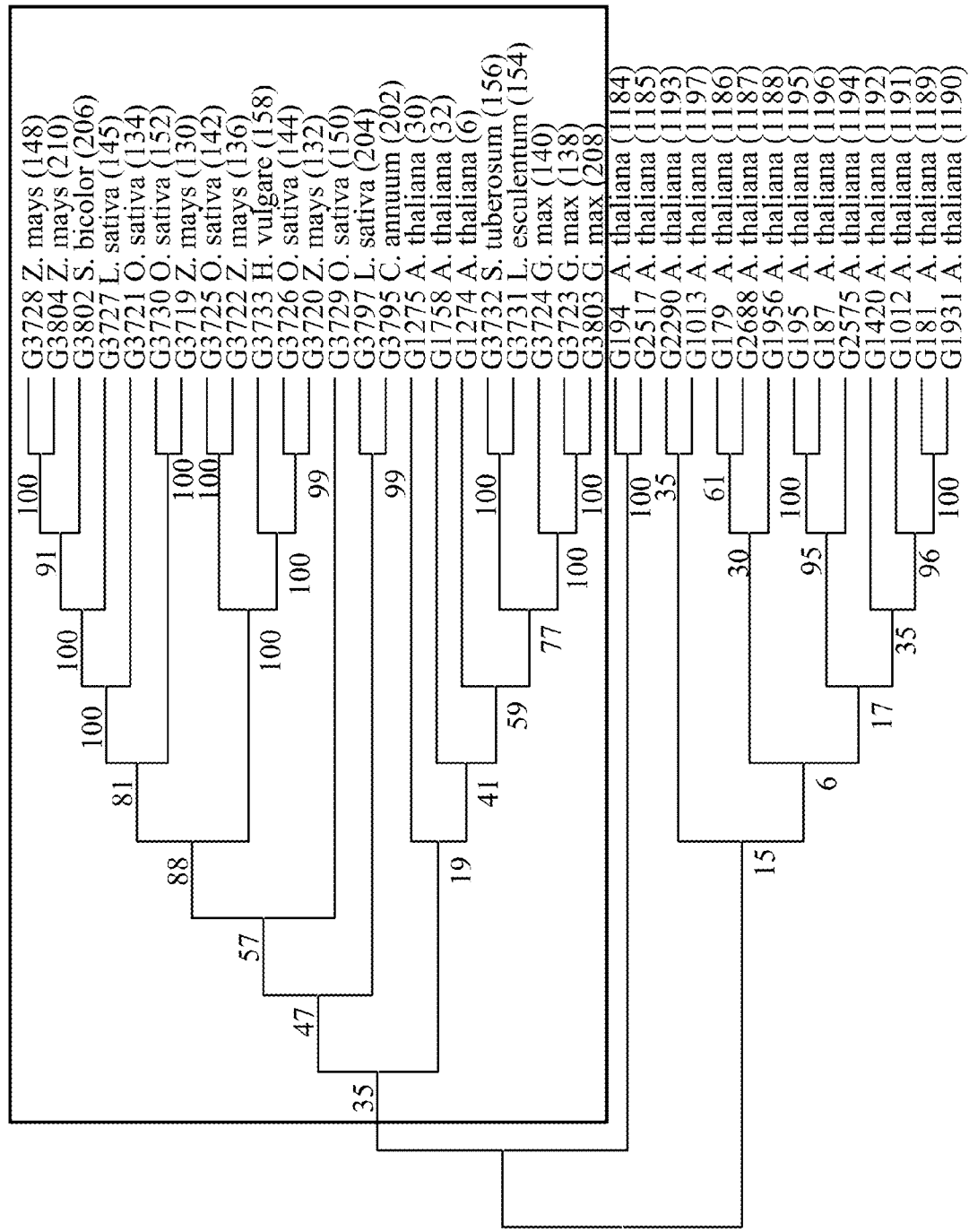

FIG. 17 represents a phylogenetic tree for the G1274 paralogs and orthologs. Full length, predicted protein sequences were used to construct a bootstrapped (1000 replicates) neighbor-joining tree. Gaps and missing data were handled using pairwise deletion and the distance method used was p-distance. Sequences within the G1274 clade appear within the box.

FIGS. 18A-18BB show a multiple sequence alignment of predicted protein sequences from G2053, and its paralogs and orthologs. The first column shows the sequence name followed by the SEQ ID No. in parentheses. The sequences within the G2053 clade are indicated by the black bar to the left of the alignment. The amino acid residues in boldface are consensus residues, and those within the boxes represent conserved, similar residues. Sequences without a species identifier were found in *Arabidopsis*.

Figure 19:
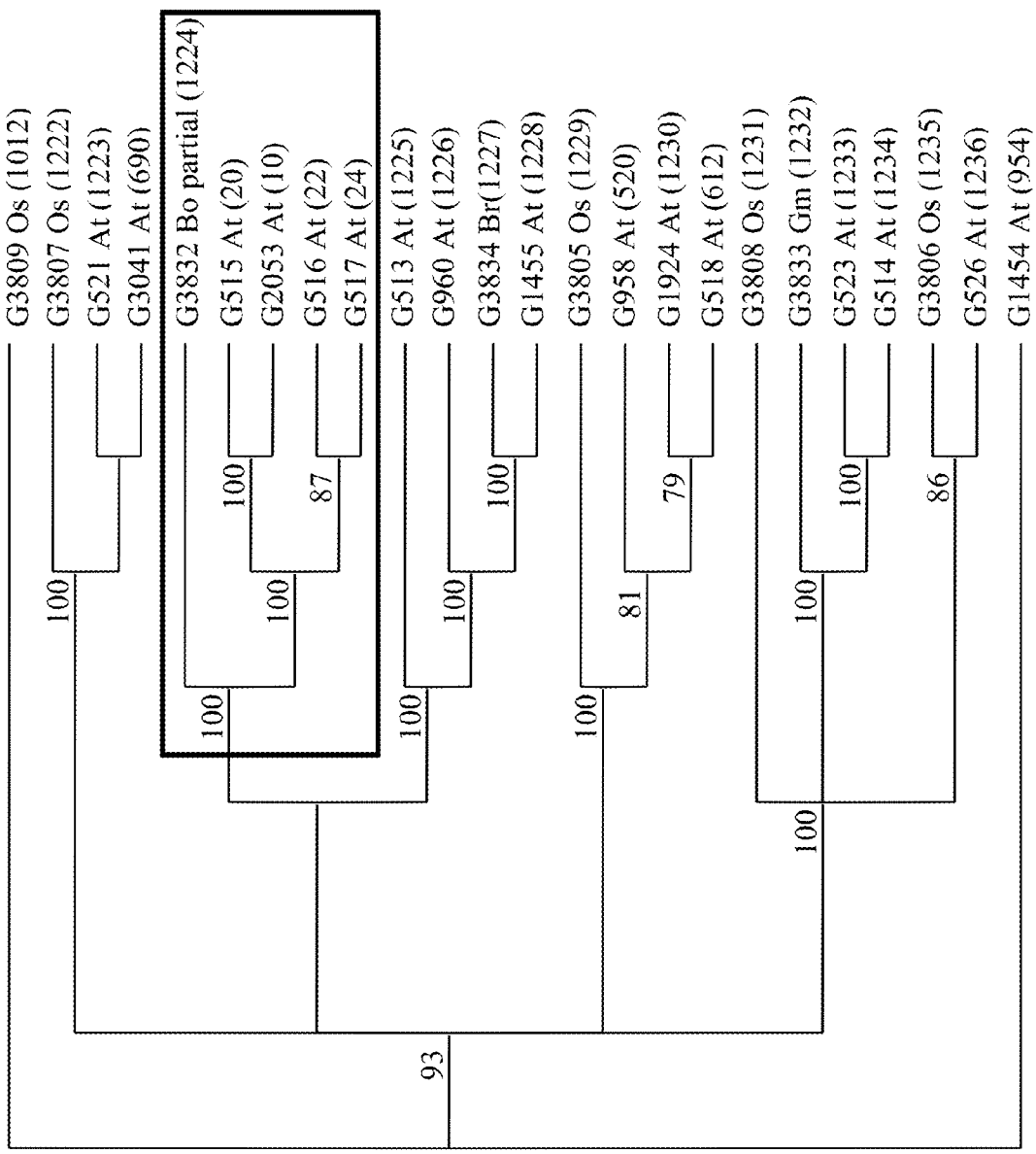

FIG. 19 is a phylogenetic tree for the G2053 paralogs and orthologs. Full length, predicted protein sequences were used to construct a bootstrapped (1000 replicates) neighbor-joining tree. Gaps and missing data were handled using pairwise deletion and the distance method used was p-distance. Sequences within the G2053 clade appear within the box.

FIGS. 20A and 20B show the conserved domains making up the DNA binding domains of G682-like proteins from *Arabidopsis*, soybean, rice, and corn. The first column shows the sequence name followed by the SEQ ID No. in parentheses. G682 and its paralogs and orthologs are almost entirely composed of a single repeat MYB-related DNA binding domain that is highly conserved across plant species. The polypeptide sequences that are representatives of the G682 subclade are denoted by the vertical bar to the left of the subsequences. The residues in the boxes in FIG. 20B may be used to identify G682 subclade members. The residues indicated by the arrows and in the boxes in FIG. 20B have not been found at corresponding positions in sequences outside of the G682 subclade. Prior to this disclosure, no function such as those presented in Example VIII has been identified for any of the non-*Arabidopsis* MYB-related sequences in the G682 subclade.

Figure 21:
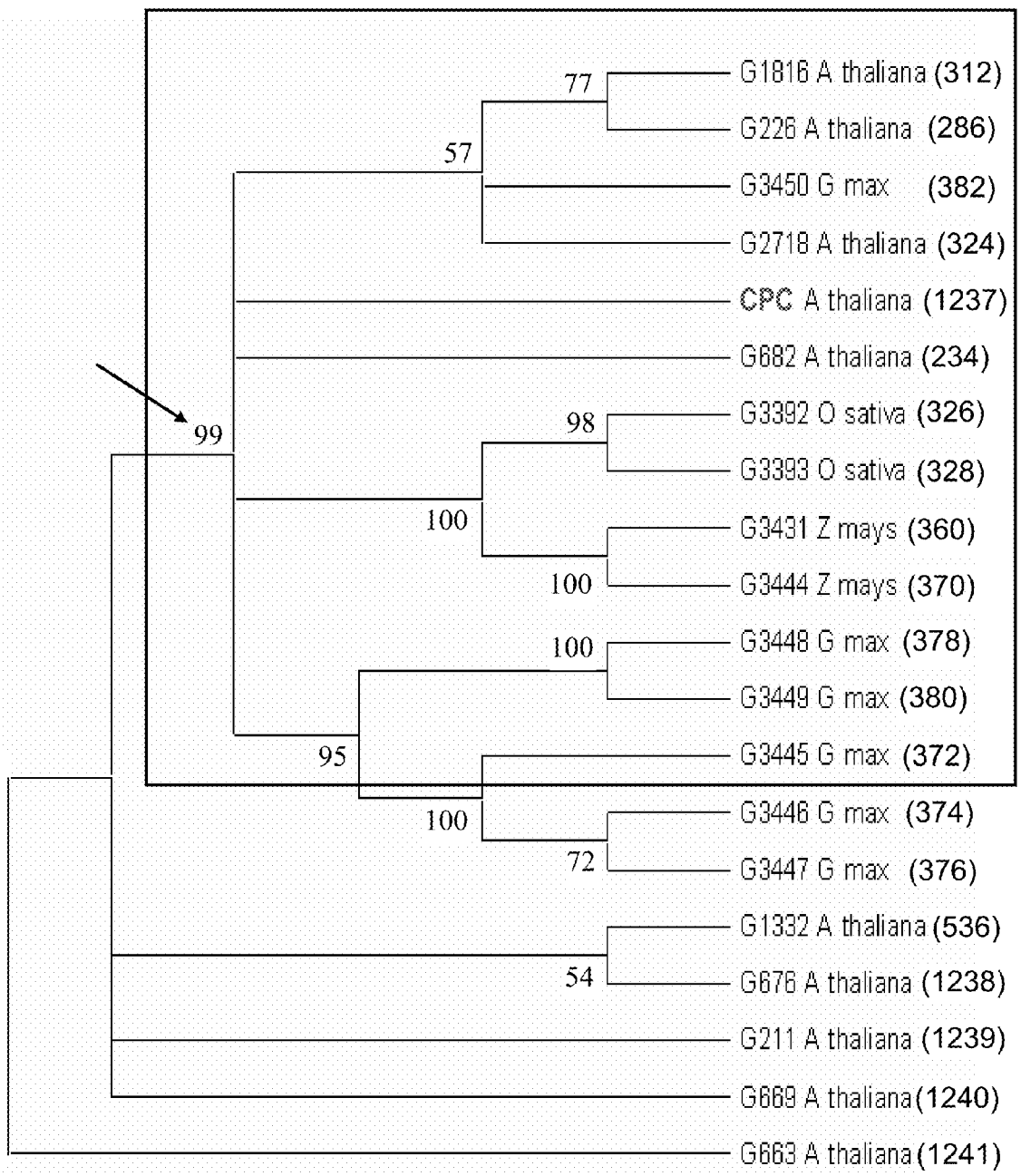

FIG. 21 illustrates the relationship of G682 and related sequences in this phylogenetic tree of the G682 subclade and similar sequences. This phylogenetic tree of defined conserved domains of G682 and related polypeptides was constructed with ClustalW (CLUSTAL W Multiple Sequence Alignment Program version 1.83, 2003) and MEGA2 (http://www.megasoftware.net) software. ClustalW multiple alignment parameters were as follows:

Gap Opening Penalty: 10.00
Gap Extension Penalty: 0.20
Delay divergent sequences: 30%
DNA Transitions Weight: 0.50
Protein weight matrix: Gonnet series
DNA weight matrix: IUB
Use negative matrix: OFF A FastA formatted alignment was then used to generate a phylogenetic tree in MEGA2 using the neighbor joining algorithm and a p-distance model. A test of phylogeny was done via bootstrap with 100 replications and Random Speed set to default. Cut off values of the bootstrap tree were set to 50%. The G682 subclade of MYB-related transcription factors, a group of structurally and functionally related sequences that derive from a single ancestral node (arrow), appears within the box in FIG. 21. Most of the members of the subclade within the box have been shown to confer abiotic stress tolerance and/or altered C/N sensing when the polypeptides are overexpressed (see Table 13).

Figure 22:
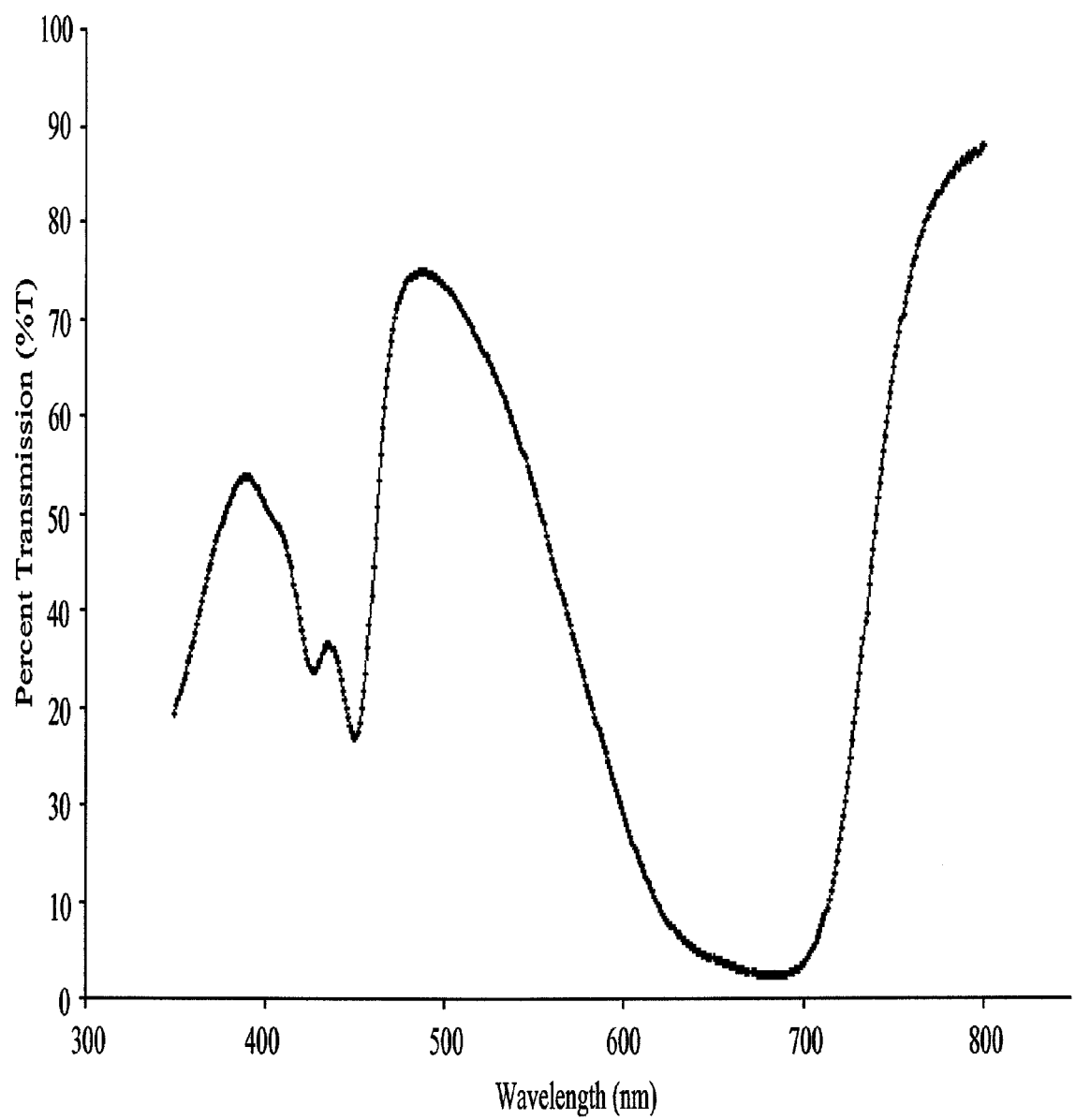

FIG. 22 is a graph representing light quality (percent transmission vs. wavelength) in the controlled environment plant growth chamber used for the shade avoidance studies. Because shading is detected using phytochrome to sense the R:FR ratio in light, we can mimic the effect of shading by using a filter designed to prevent only the transmission of red wavelengths. To determine whether the mechanisms used to sense shading are altered, we exploit the observation that seedlings of wild-type plants grown under light deficient in red wavelengths have extended hypocotyls, indicating a shade avoidance phenotype. Plants overexpressing genes which produce short hypocotyls under these conditions, and exhibit a shade tolerance phenotype, would be candidates for further examination in more rigorous studies (e.g., by looking at components such as yield under high densities in greenhouse studies). For the data seen in FIG. 22, a small piece of the filter was removed and used to determine the percent transmission with a Beckman DU-650 spectrophotometer. This filter effectively removed the red region of the visible spectrum yet allowed far-red and blue to pass through.

Figure 23:
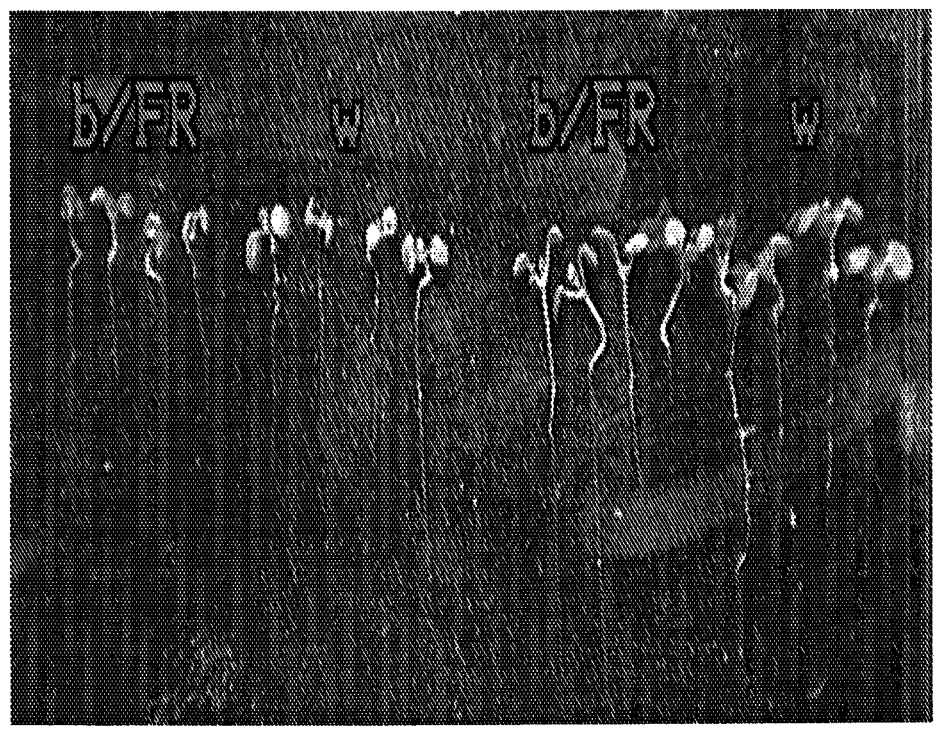

FIG. 23 shows the results of an experiment with 35S:: G634 plants versus wild type. Individual seedlings were compared after being grown under light deficient in red wavelengths (b/FR) and white light (w). The G634 overexpressors did not exhibit a shade avoidance phenotype, as indicated by their short hypocotyls produced under these conditions.

DETAILED DESCRIPTION OF THE SPECIFIC EMBODIMENTS

The data presented herein represent the results of a screen of a transcription factor collection to identify genes that can be applied to reduce yield losses that arise from low nutrient, drought-related stress, and/or shade avoidance responses.

We have identified numerous transcription factor genes that confer improved drought-tolerance relative to wild type plants when their expression is altered, such as by overexpression or knocking-out of the gene in transgenic plants. Thus, the present invention is directed in part to recombinant polynucleotides that confer drought-related stress tolerance in plants when the expression of recombinant polynucleotides of the invention is altered (e.g., by overexpression). In the present studies, soil-based assays were performed in which transgenic plants are first deprived of water, evaluated by comparison to control plants, rewatered, and their recovery also evaluated by comparison to control plants similarly treated.

We have also identified numerous transcription factor genes that confer altered C/N sensing in transgenic *Arabidopsis* plants. These experiments were carried out in two phases. A primary screen was done on seed lots comprised of seed mixed together from each of two or three independent primary transformants, or on a homozygous population in the case of the knockout lines. Any lot which showed a C/N sensing phenotype was subjected to a repeat experiment. Transgenic lines that exhibited an altered C/N sensing phenotype in repeat experiments, as compared to control plants, are shown in the tables and Sequence Listing.

A secondary screen was then conducted in which either two or three individual overexpression lines (or a different homozygous seed lot, in the case of knockout lines) were retested in the assay. The individual transgenic lines that showed prominent phenotypes in the second round assay were given an "A" priority ranking. The set of sequences assigned a "B" priority ranking in the results table have yet to be confirmed in the secondary screen or did not show a prominent phenotype.

We have also identified numerous transcription factor genes that confer shade tolerance in transgenic *Arabidopsis* plants. The principle behind the experiment was as follows: angiosperm plants have evolved mechanisms to compete with neighboring vegetation for light. When incident light is filtered or reflected by adjacent plants, the red wavelengths of the spectrum are removed, resulting in a fall in the ratio of red to far red light that the plant perceives. These changes are detected via the phytochrome photoreceptors and result in extension type growth and accelerated flowering. Such responses reduce the resources available for storage and reproduction, which in turn results in poor fruit and seed development and reduced yield. Given that shade avoidance responses are often initiated in crops at planting densities where light availability is not a limiting growth factor, genes that suppress such effects would offer yield savings.

In the experiments presented herein, overexpression and mutant *Arabidopsis* lines for a transcription factor collection were grown under light that was deficient in red wavelengths, and was therefore equivalent to light shaded by vegetation. Transcription factors were identified that conferred shade tolerance and prevented the elongated growth that was produced in wild-type controls under such conditions.

The present invention relates in part to polynucleotides and polypeptides, for example, for modifying phenotypes of plants, particularly those associated with altered C/N sensing, and improved drought stress and shade tolerance. Throughout this disclosure, various information sources are referred to and/or are specifically incorporated. The information sources include scientific journal articles, patent documents, textbooks, and World Wide Web browser-inactive page addresses. While the reference to these information sources clearly indicates that they can be used by one of skill in the art, each and every one of the information sources cited herein are specifically incorporated in their entirety, whether or not a specific mention of "incorporation by reference" is noted. The contents and teachings of each and every one of the information sources can be relied on and used to make and use embodiments of the invention.

As used herein and in the appended claims, the singular forms "a," "an," and "the" include plural reference unless the context clearly dictates otherwise. Thus, for example, a reference to "a plant" includes a plurality of such plants, and a reference to "a stress" is a reference to one or more stresses and equivalents thereof known to those skilled in the art, and so forth.

Definitions

"Nucleic acid molecule" refers to an oligonucleotide, polynucleotide or any fragment thereof. It may be DNA or RNA of genomic or synthetic origin, double-stranded or single-stranded, and combined with carbohydrate, lipids, protein, or other materials to perform a particular activity such as transformation or form a useful composition such as a peptide nucleic acid (PNA).

"Polynucleotide" is a nucleic acid molecule comprising a plurality of polymerized nucleotides, for example, at least about 15 or more consecutive polymerized nucleotides. A polynucleotide may be a nucleic acid, oligonucleotide, nucleotide, or any fragment thereof. In many instances, a polynucleotide comprises a nucleotide sequence encoding a polypeptide (or protein) or a domain or fragment thereof. Additionally, the polynucleotide may comprise a promoter, an intron, an enhancer region, a polyadenylation site, a translation initiation site, 5' or 3' untranslated regions, a reporter gene, a selectable marker, or the like. The polynucleotide can be single-stranded or double-stranded DNA or RNA. The polynucleotide optionally comprises modified bases or a modified backbone. The polynucleotide can be, for example, genomic DNA or RNA, a transcript (such as an mRNA), a cDNA, a PCR product, a cloned DNA, a synthetic DNA or RNA, or the like. The polynucleotide can be combined with carbohydrate, lipids, protein, or other materials to perform a particular activity such as transformation or form a useful composition such as a peptide nucleic acid (PNA). The polynucleotide can comprise a sequence in either sense or antisense orientations. "Oligonucleotide" is substantially equivalent to the terms amplimer, primer, oligomer, element, target, and probe and is preferably single-stranded.

"Gene" or "gene sequence" refers to the partial or complete coding sequence of a gene, its complement, and its 5' or 3' untranslated regions. A gene is also a functional unit of inheritance, and in physical terms is a particular segment or sequence of nucleotides along a molecule of DNA (or RNA, in the case of RNA viruses) involved in producing a polypeptide chain. The latter may be subjected to subsequent processing such as chemical modification, splicing and folding to obtain a functional protein or polypeptide. A gene may be isolated, partially isolated, or be found with an organism's genome. By way of example, a transcription factor gene encodes a transcription factor polypeptide, which may be functional or require processing to function as an initiator of transcription.

Operationally, genes may be defined by the cis-trans test, a genetic test that determines whether two mutations occur in the same gene and that may be used to determine the limits of the genetically active unit (Rieger et al. (1976) *Glossary of Genetics and Cytogenetics: Classical and Molecular*, 4th ed., Springer Verlag. Berlin). A gene generally includes regions preceding ("leaders"; upstream) and following ("trailers"; downstream) the coding region. A gene may also include intervening, non-coding sequences, referred to as "introns", located between individual coding segments, referred to as "exons". Most genes have an associated promoter region, a regulatory sequence 5' of the transcription initiation codon (there are some genes that do not have an identifiable promoter). The function of a gene may also be regulated by enhancers, operators, and other regulatory elements.

A "recombinant polynucleotide" is a polynucleotide that is not in its native state, for example, the polynucleotide comprises a nucleotide sequence not found in nature, or the polynucleotide is in a context other than that in which it is naturally found, for example, separated from nucleotide sequences with which it typically is in proximity in nature, or adjacent (or contiguous with) nucleotide sequences with which it typically is not in proximity. For example, the sequence at issue can be cloned into a vector, or otherwise recombined with one or more additional nucleic acid.

An "isolated polynucleotide" is a polynucleotide, whether naturally occurring or recombinant, that is present outside the cell in which it is typically found in nature, whether purified or not. Optionally, an isolated polynucleotide is subject to one or more enrichment or purification procedures, for example, cell lysis, extraction, centrifugation, precipitation, or the like.

A "polypeptide" is an amino acid sequence comprising a plurality of consecutive polymerized amino acid residues for example, at least about 15 consecutive polymerized amino acid residues. In many instances, a polypeptide comprises a polymerized amino acid residue sequence that is a transcription factor or a domain or portion or fragment thereof. Additionally, the polypeptide may comprise: (i) a localization domain; (ii) an activation domain; (iii) a repression domain; (iv) an oligomerization domain; or (v) a DNA-binding domain, or the like. The polypeptide optionally comprises modified amino acid residues, naturally occurring amino acid residues not encoded by a codon, or non-naturally occurring amino acid residues.

"Protein" refers to an amino acid sequence, oligopeptide, peptide, polypeptide or portions thereof whether naturally occurring or synthetic.

"Portion", as used herein, refers to any part of a protein used for any purpose, but especially for the screening of a library of molecules that specifically bind to that portion or for the production of antibodies.

A "recombinant polypeptide" is a polypeptide produced by translation of a recombinant polynucleotide. A "synthetic polypeptide" is a polypeptide created by consecutive polymerization of isolated amino acid residues using methods well known in the art. An "isolated polypeptide," whether a naturally occurring or a recombinant polypeptide, is more enriched in (or out of) a cell than the polypeptide in its natural state in a wild-type cell, for example, more than about 5% enriched, or at least 105% relative to wild type standardized at 100%. Such an enrichment is not the result of a natural response of a wild-type plant. Alternatively, or additionally, the isolated polypeptide is separated from other cellular components with which it is typically associated, for example, by any of the various protein purification methods herein.

"Homology" refers to sequence similarity between a reference sequence and at least a fragment of a newly sequenced clone insert or its encoded amino acid sequence. Additionally, the terms "homology" and "homologous sequence(s)" may refer to one or more polypeptide sequences that are modified by chemical or enzymatic means. The homologous sequence may be a sequence modified by lipids, sugars, peptides, organic or inorganic compounds, by the use of modified amino acids or the like. Protein modification techniques are illustrated in Ausubel et al. (eds) *Current Protocols in Molecular Biology*, John Wiley & Sons (1998).

"Identity" or "similarity" refers to sequence similarity between two polynucleotide sequences or between two polypeptide sequences, with identity being a more strict comparison. The phrases "percent identity" and "% identity" refer to the percentage of sequence similarity found in a comparison of two or more polynucleotide sequences or two or more polypeptide sequences. "Sequence similarity" refers to the percent similarity in base pair sequence (as determined by any suitable method) between two or more polynucleotide sequences. Two or more sequences can be anywhere from 0-100% similar, or any integer value therebetween. Identity or similarity can be determined by comparing a position in each sequence that may be aligned for purposes of comparison. When a position in the compared sequence is occupied by the same nucleotide base or amino acid, then the molecules are identical at that position. A degree of similarity or identity between polynucleotide sequences is a function of the number of identical, matching of corresponding nucleotides at positions shared by the polynucleotide sequences. A degree of identity of polypeptide sequences is a function of the number of identical amino acids at corresponding positions shared by the polypeptide sequences. A degree of homology or similarity of polypeptide sequences is a function of the number of amino acids at corresponding positions shared by the polypeptide sequences.

With regard to polypeptides, the terms "substantial identity" or "substantially identical" may refer to sequences of sufficient similarity and structure to the transcription factors in the Sequence Listing to produce similar function when expressed or overexpressed in a plant; in the present invention, this function is altered C/N sensing or increased tolerance to drought or shade. Sequences that are at least about 50% identical, and preferably at least 82% identical, to the instant polypeptide sequences are considered to have "substantial identity" with the latter. Sequences having lesser degrees of identity but comparable biological activity are considered to be equivalents. The structure required to maintain proper functionality is related to the tertiary structure of the polypeptide. There are discreet domains and motifs within a transcription factor that must be present within the polypeptide to confer function and specificity. These specific structures are required so that interactive sequences will be properly oriented to retain the desired activity. "Substantial identity" may thus also be used with regard to subsequences, for example, motifs, that are of sufficient structure and similarity, being at least about 50% identical, and preferably at least 82% identical, to similar motifs in other related sequences so that each confers or is required for altered C/N sensing or increased tolerance to drought or shade.

The term "amino acid consensus motif" refers to the portion or subsequence of a polypeptide sequence that is substantially conserved among the polypeptide transcription factors listed in the Sequence Listing.

"Alignment" refers to a number of nucleotide or amino acid residue sequences aligned by lengthwise comparison so that components in common (i.e., nucleotide bases or amino acid residues) may be visually and readily identified. The fraction or percentage of components in common is related to the homology or identity between the sequences. Alignments such as those found the Figures may be used to identify conserved domains and relatedness within these domains. An alignment may suitably be determined by means of computer programs known in the art, such as MacVector (1999) (Accelrys, Inc., San Diego, Calif.).

A "conserved domain" or "conserved region" as used herein refers to a region in heterologous polynucleotide or polypeptide sequences where there is a relatively high degree of sequence identity between the distinct sequences. AP2 domains are examples of conserved domains.

With respect to polynucleotides encoding presently disclosed transcription factors, a conserved domain is preferably at least 10 base pairs (bp) in length.

A "conserved domain", with respect to presently disclosed polypeptides refers to a domain within a transcription factor family that exhibits a higher degree of sequence homology, such as at least 70% sequence similarity, including conservative substitutions, and more preferably at least 79% sequence identity, and even more preferably at least 81%, or at least about 86%, or at least about 87%, or at least about 89%, or at least about 91%, or at least about 95%, or at least about 98% amino acid residue sequence identity to the conserved domain. Sequences are also encompassed by the invention that possess or encode conserved domains that recognizable fall within a given clade of transcription factor polypeptides and that have comparable biological activity to the sequences of this invention. A fragment or domain can be referred to as outside a conserved domain, outside a consensus sequence, or outside a consensus DNA-binding site that is known to exist or that exists for a particular transcription factor class, family, or sub-family. In this case, the fragment or domain will not include the exact amino acids of a consensus sequence or consensus DNA-binding site of a transcription factor class, family or sub-family, or the exact amino acids of a particular transcription factor consensus sequence or consensus DNA-binding site. Furthermore, a particular fragment, region, or domain of a polypeptide, or a polynucleotide encoding a polypeptide, can be "outside a conserved domain" if all the amino acids of the fragment, region, or domain fall outside of a defined conserved domain(s) for a polypeptide or protein. Sequences having lesser degrees of identity but comparable biological activity are considered to be equivalents.

As one of ordinary skill in the art recognizes, conserved domains may be identified as regions or domains of identity to a specific consensus sequence (for example, Riechmann et al. (2000) supra). Thus, by using alignment methods well known in the art, the conserved domains of the AP2 plant transcription factors may be determined.

The conserved domains for a number of the sequences that confer drought tolerance and altered C/N sensing are found in Tables 1 and 3, respectively. A comparison of the regions of the polypeptides in Table 1 or 3 allows one of skill in the art to identify conserved domains for any of the polypeptides listed or referred to in this disclosure.

"Complementary" refers to the natural hydrogen bonding by base pairing between purines and pyrimidines. For example, the sequence A-C-G-T (5'→3') forms hydrogen bonds with its complements A-C-G-T (5'→3') or A-C-G-U (5'→3'). Two single-stranded molecules may be considered partially complementary, if only some of the nucleotides bond, or "completely complementary" if all of the nucleotides bond. The degree of complementarity between nucleic acid strands affects the efficiency and strength of hybridization and amplification reactions. "Fully complementary" refers to the case where bonding occurs between every base pair and its complement in a pair of sequences, and the two sequences have the same number of nucleotides.

The terms "highly stringent" or "highly stringent condition" refer to conditions that permit hybridization of DNA strands whose sequences are highly complementary, wherein these same conditions exclude hybridization of significantly mismatched DNAs. Polynucleotide sequences capable of hybridizing under stringent conditions with the polynucleotides of the present invention may be, for example, variants of the disclosed polynucleotide sequences, including allelic or splice variants, or sequences that encode orthologs or paralogs of presently disclosed polypeptides. Nucleic acid hybridization methods are disclosed in detail by Kashima et al. (1985) *Nature* 313:402-404, Sambrook et al. (1989) *Molecular Cloning: A Laboratory Manual*, 2nd Ed., Cold Spring Harbor Laboratory, Cold Spring Harbor, N.Y. ("Sambrook"), and by Hames and Higgins, "*Nucleic Acid Hybridisation: A Practical Approach*", IRL Press, Washington, D.C. (1985), which references are incorporated herein by reference.

In general, stringency is determined by the temperature, ionic strength, and concentration of denaturing agents (for example, formamide) used in a hybridization and washing procedure (for a more detailed description of establishing and determining stringency, see below). The degree to which two nucleic acids hybridize under various conditions of stringency is correlated with the extent of their similarity. Thus, similar nucleic acid sequences from a variety of sources, such as within a plant's genome (as in the case of paralogs) or from another plant (as in the case of orthologs) that may perform similar functions can be isolated on the basis of their ability to hybridize with known transcription factor sequences. Numerous variations are possible in the conditions and means by which nucleic acid hybridization can be performed to isolate transcription factor sequences having similarity to transcription factor sequences known in the art and are not limited to those explicitly disclosed herein. Such an approach may be used to isolate polynucleotide sequences having various degrees of similarity with disclosed transcription factor sequences, such as, for example, transcription factors having 60% identity, or more preferably greater than about 70% identity, most preferably 72% or greater identity with disclosed transcription factors.

Regarding the terms "paralog" and "ortholog", homologous polynucleotide sequences and homologous polypeptide sequences may be paralogs or orthologs of the claimed polynucleotide or polypeptide sequence. Orthologs and paralogs are evolutionarily-related genes that have similar sequence and similar functions. Orthologs are structurally related genes in different species that are derived by a speciation event. Paralogs are structurally related genes within a single species that are derived by a duplication event. Sequences that are sufficiently similar to one another will be appreciated by those of skill in the art and may be based upon percentage identity of the complete sequences, percentage identity of a conserved domain or sequence within the complete sequence, percentage similarity to the complete sequence, percentage similarity to a conserved domain or sequence within the complete sequence, and/or an arrangement of contiguous nucleotides or peptides particular to a conserved domain or complete sequence. Sequences that are sufficiently similar to one another will also bind in a similar manner to the same DNA binding sites of transcriptional regulatory elements using methods well known to those of skill in the art.

The term "equivalog" describes members of a set of homologous proteins that are conserved with respect to function since their last common ancestor. Related proteins are grouped into equivalog families, and otherwise into protein families with other hierarchically defined homology types. This definition is provided at the Institute for Genomic Research (TIGR) world wide web (www) website, "tigr.org" under the heading "Terms associated with TIGR-FAMs".

The term "variant", as used herein, may refer to polynucleotides or polypeptides that differ from the presently disclosed polynucleotides or polypeptides, respectively, in sequence from each other, and as set forth below.

With regard to polynucleotide variants, differences between presently disclosed polynucleotides and polynucleotide variants are limited so that the nucleotide sequences of the former and the latter are closely similar overall and, in many regions, identical. Due to the degeneracy of the genetic code, differences between the former and latter nucleotide sequences may be silent (i.e., the amino acids encoded by the polynucleotide are the same, and the variant polynucleotide sequence encodes the same amino acid sequence as the presently disclosed polynucleotide. Variant nucleotide sequences may encode different amino acid sequences, in which case such nucleotide differences will result in amino acid substitutions, additions, deletions, insertions, truncations or fusions with respect to the similar disclosed polynucleotide sequences. These variations may result in polynucleotide variants encoding polypeptides that share at least one functional characteristic. The degeneracy of the genetic code also dictates that many different variant polynucleotides can encode identical and/or substantially similar polypeptides in addition to those sequences illustrated in the Sequence Listing.

Presently disclosed polypeptide sequences and similar polypeptide variants may differ in amino acid sequence by one or more substitutions, additions, deletions, fusions and truncations, which may be present in any combination. These differences may produce silent changes and result in a functionally equivalent transcription factor. Thus, it will be readily appreciated by those of skill in the art, that any of a variety of polynucleotide sequences is capable of encoding the transcription factors and transcription factor homolog polypeptides of the invention. A polypeptide sequence variant may have "conservative" changes, wherein a substituted amino acid has similar structural or chemical properties. Deliberate amino acid substitutions may thus be made on the basis of similarity in polarity, charge, solubility, hydrophobicity, hydrophilicity, and/or the amphipathic nature of the residues, as long as a substantial amount of the functional or biological activity of the transcription factor is retained. For example, negatively charged amino acids may include aspartic acid and glutamic acid, positively charged amino acids may include lysine and arginine, and amino acids with uncharged polar head groups having similar hydrophilicity values may include leucine, isoleucine, and valine; glycine and alanine; asparagine and glutamine; serine and threonine; and phenylalanine and tyrosine (for more detail on conservative substitutions, see Table 6). More rarely, a variant may have "non-conservative" changes, for example, replacement of a glycine with a tryptophan. Similar minor variations may also include amino acid deletions or insertions, or both. Related polypeptides may comprise, for example, additions and/or deletions of one or more N-linked or O-linked glycosylation sites, or an addition and/or a deletion of one or more cysteine residues. Guidance in determining which and how many amino acid residues may be substituted, inserted or deleted without abolishing functional or biological activity may be found using computer programs well known in the art, for example, DNASTAR software (U.S. Pat. No. 5,840,544).

Also within the scope of the invention is a variant of a transcription factor nucleic acid listed in the Sequence Listing, that is, one having a sequence that differs from the one of the polynucleotide sequences in the Sequence Listing, or a complementary sequence, that encodes a functionally equivalent polypeptide (i.e., a polypeptide having some degree of equivalent or similar biological activity) but differs in sequence from the sequence in the Sequence Listing, due to degeneracy in the genetic code. Included within this definition are polymorphisms that may or may not be readily detectable using a particular oligonucleotide probe of the polynucleotide encoding polypeptide, and improper or unexpected hybridization to allelic variants, with a locus other than the normal chromosomal locus for the polynucleotide sequence encoding polypeptide.

"Allelic variant" or "polynucleotide allelic variant" refers to any of two or more alternative forms of a gene occupying the same chromosomal locus. Allelic variation arises naturally through mutation, and may result in phenotypic polymorphism within populations. Gene mutations may be "silent" or may encode polypeptides having altered amino acid sequence. "Allelic variant" and "polypeptide allelic variant" may also be used with respect to polypeptides, and in this case the term refer to a polypeptide encoded by an allelic variant of a gene.

"Splice variant" or "polynucleotide splice variant" as used herein refers to alternative forms of RNA transcribed from a gene. Splice variation naturally occurs as a result of alternative sites being spliced within a single transcribed RNA molecule or between separately transcribed RNA molecules, and may result in several different forms of mRNA transcribed from the same gene. Thus, splice variants may encode polypeptides having different amino acid sequences, which may or may not have similar functions in the organism. "Splice variant" or "polypeptide splice variant" may also refer to a polypeptide encoded by a splice variant of a transcribed mRNA.

As used herein, "polynucleotide variants" may also refer to polynucleotide sequences that encode paralogs and orthologs of the presently disclosed polypeptide sequences. "Polypeptide variants" may refer to polypeptide sequences that are paralogs and orthologs of the presently disclosed polypeptide sequences.

"Ligand" refers to any molecule, agent, or compound that will bind specifically to a complementary site on a nucleic acid molecule or protein. Such ligands stabilize or modulate the activity of nucleic acid molecules or proteins of the invention and may be composed of at least one of the following: inorganic and organic substances including nucleic acids, proteins, carbohydrates, fats, and lipids.

"Modulates" refers to a change in activity (biological, chemical, or immunological) or lifespan resulting from specific binding between a molecule and either a nucleic acid molecule or a protein.

The term "plant" includes whole plants, shoot vegetative organs/structures (for example, leaves, stems and tubers), roots, flowers and floral organs/structures (for example, bracts, sepals, petals, stamens, carpels, anthers and ovules), seed (including embryo, endosperm, and seed coat) and fruit (the mature ovary), plant tissue (for example, vascular tissue, ground tissue, and the like) and cells (for example, guard cells, egg cells, and the like), and progeny of same. The class of plants that can be used in the method of the invention is generally as broad as the class of higher and lower plants amenable to transformation techniques, including angiosperms (monocotyledonous and dicotyledonous plants), gymnosperms, ferns, horsetails, psilophytes, lycophytes, bryophytes, and multicellular algae (as shown, for example, in FIG. 1, adapted from Daly et al. (2001) *Plant Physiol.* 127: 1328-1333, and in FIG. 2, adapted from Ku et al. (2000) *Proc. Natl. Acad. Sci.* 97: 9121-9126; and in Tudge (2000) in *The Variety of Life*, Oxford University Press, New York, N.Y., pp. 547-606).

A "transgenic plant" refers to a plant that contains genetic material not found in a wild-type plant of the same species, variety or cultivar. The genetic material may include a transgene, an insertional mutagenesis event (such as by transposon or T-DNA insertional mutagenesis), an activation tagging sequence, a mutated sequence, a homologous recombination event or a sequence modified by chimeraplasty. Typically, the foreign genetic material has been introduced into the plant by human manipulation, but any method can be used as one of skill in the art recognizes.

A transgenic plant may contain an expression vector or cassette. The expression cassette typically comprises a polypeptide-encoding sequence operably linked (i.e., under regulatory control of) to appropriate inducible or constitutive regulatory sequences that allow for the expression of polypeptide. The expression cassette can be introduced into a plant by transformation or by breeding after transformation of a parent plant. A plant refers to a whole plant as well as to a plant part, such as seed, fruit, leaf, or root, plant tissue, plant cells or any other plant material, for example, a plant explant, as well as to progeny thereof, and to in vitro systems that mimic biochemical or cellular components or processes in a cell.

"Wild type" or "wild-type", as used herein, refers to a plant cell, seed, plant component, plant tissue, plant organ or whole plant that has not been genetically modified or treated in an experimental sense. Wild-type cells, seed, components, tissue, organs or whole plants may be used as controls to compare levels of expression and the extent and nature of trait modification with cells, tissue or plants of the same species in which a transcription factor expression is altered, for example, in that it has been knocked out, overexpressed, or ectopically expressed.

A "control plant" as used in the present invention refers to a plant cell, seed, plant component, plant tissue, plant organ or whole plant used to compare against transgenic or genetically modified plant for the purpose of identifying an enhanced phenotype in the transgenic or genetically modified plant. A control plant may in some cases be a transgenic plant line that comprises an empty vector or marker gene, but does not contain the recombinant polynucleotide of the present invention that is expressed in the transgenic or genetically modified plant being evaluated. In general, a control plant is a plant of the same line or variety as the transgenic or genetically modified plant being tested. A suitable control plant would include a genetically unaltered or non-transgenic plant of the parental line used to generate a transgenic plant herein.

"Fragment", with respect to a polynucleotide, refers to a clone or any part of a polynucleotide molecule that retains a usable, functional characteristic. Useful fragments include oligonucleotides and polynucleotides that may be used in hybridization or amplification technologies or in the regulation of replication, transcription or translation. A "polynucleotide fragment" refers to any subsequence of a polynucleotide, typically, of at least about nine consecutive nucleotides, preferably at least about 30 nucleotides, more preferably at least about 50 nucleotides, of any of the sequences provided herein. Exemplary polynucleotide fragments are the first sixty consecutive nucleotides of the transcription factor polynucleotides listed in the Sequence Listing. Exemplary fragments include fragments comprising a region that encodes a conserved domain (for example, an AP2 domain) of a transcription factor.

Fragments may also include subsequences of polypeptides and protein molecules, or a subsequence of the polypeptide. Fragments may have uses in that they may have antigenic potential. In some cases, the fragment or domain is a subsequence of the polypeptide which performs at least one biological function of the intact polypeptide in substantially the same manner, or to a similar extent, as does the intact polypeptide. For example, a polypeptide fragment can comprise a recognizable structural motif or functional domain such as a DNA-binding site or domain that binds to a DNA promoter region, an activation domain, or a domain for protein-protein interactions, and may initiate transcription. Fragments can vary in size from as few as 3 amino acid residues to the full length of the intact polypeptide, but are preferably at least about 30 amino acid residues in length and more preferably at least about 60 amino acid residues in length. Exemplary polypeptide fragments are the first twenty consecutive amino acids of the transcription factor polypeptides listed in the Sequence Listing. Exemplary fragments also include fragments that comprise an AP2 domain of a transcription factor, for example, amino acid residues 10-77 of G2133 (SEQ ID NO: 12), as noted in Table 1.

The invention also encompasses production of DNA sequences that encode transcription factors and transcription factor derivatives, or fragments thereof, entirely by synthetic chemistry. After production, the synthetic sequence may be inserted into any of the many available expression vectors and cell systems using reagents well known in the art. Moreover, synthetic chemistry may be used to introduce mutations into a sequence encoding transcription factors or any fragment thereof.

"Derivative" refers to the chemical modification of a nucleic acid molecule or amino acid sequence. Chemical modifications can include replacement of hydrogen by an alkyl, acyl, or amino group or glycosylation, pegylation, or any similar process that retains or enhances biological activity or lifespan of the molecule or sequence.

A "trait" refers to a physiological, morphological, biochemical, or physical characteristic of a plant or particular plant material or cell. In some instances, this characteristic is visible to the human eye, such as seed or plant size, or can be measured by biochemical techniques, such as detecting the protein, starch, or oil content of seed or leaves, or by observation of a metabolic or physiological process, for example, by measuring tolerance to water deprivation or particular salt or sugar concentrations, or by the observation of the expression level of a gene or genes, for example, by employing Northern analysis, RT-PCR, microarray gene expression assays, or reporter gene expression systems, or by agricultural observations such as drought stress tolerance or yield. Any technique can be used to measure the amount of, comparative level of, or difference in any selected chemical compound or macromolecule in the transgenic plants, however.

"Trait modification" refers to a detectable difference in a characteristic in a plant ectopically expressing a polynucleotide or polypeptide of the present invention relative to a plant not doing so, such as a wild-type plant. In some cases, the trait modification can be evaluated quantitatively. For example, the trait modification can entail at least about a 2% increase or decrease in an observed trait, or an even greater difference, as compared with a wild-type or control plant. It is known that there can be a natural variation in the modified trait. Therefore, the trait modification observed entails a change of the normal distribution and magnitude of the trait in the plants compared with the distribution and magnitude observed in wild-type plants.

The term "transcript profile" refers to the expression levels of a set of genes in a cell in a particular state, particularly by comparison with the expression levels of that same set of genes in a cell of the same type in a reference state. For example, the transcript profile of a particular transcription factor in a suspension cell is the expression levels of a set of genes in a cell repressing or overexpressing that transcription factor compared with the expression levels of that same set of genes in a suspension cell that has normal levels of that transcription factor. The transcript profile can be presented as a list of those genes whose expression level is significantly different between the two treatments, and the difference ratios. Differences and similarities between expression levels may also be evaluated and calculated using statistical and clustering methods.

"Ectopic expression or altered expression" in reference to a polynucleotide indicates that the pattern of expression in, for example, a transgenic plant or plant tissue, is different from the expression pattern in a wild-type plant or a reference plant of the same species. The pattern of expression may also be compared with a reference expression pattern in a wild-type plant of the same species. For example, the polynucleotide or polypeptide is expressed in a cell or tissue type other than a cell or tissue type in which the sequence is expressed in the wild-type plant, or by expression at a time other than at the time the sequence is expressed in the wild-type plant, or by a response to different inducible agents, such as hormones or environmental signals, or at different expression levels (either higher or lower) compared with those found in a wild-type plant. The term also refers to altered expression patterns that are produced by lowering the levels of expression to below the detection level or completely abolishing expression. The resulting expression pattern can be transient or stable, constitutive or inducible. In reference to a polypeptide, the term "ectopic expression or altered expression" further may relate to altered activity levels resulting from the interactions of the polypeptides with exogenous or endogenous modulators or from interactions with factors or as a result of the chemical modification of the polypeptides.

The term "overexpression" as used herein refers to a greater expression level of a gene in a plant, plant cell or plant tissue, compared to expression in a wild-type plant, cell or tissue, at any developmental or temporal stage for the gene. Overexpression can occur when, for example, the genes encoding one or more transcription factors are under the control of a strong promoter described herein (for example, the cauliflower mosaic virus 35S transcription initiation region), or overexpression can be induced when an appropriate environmental signal is present. Overexpression may occur throughout a plant or in specific tissues of the plant, depending on the promoter used, as described below.

Overexpression may take place in plant cells normally lacking expression of polypeptides functionally equivalent or identical to the present transcription factors. Overexpression may also occur in plant cells where endogenous expression of the present transcription factors or functionally equivalent molecules normally occurs, but such normal expression is at a lower level. Overexpression thus results in a greater than normal production, or "overproduction" of the transcription factor in the plant, cell or tissue.

The term "transcription regulating region" refers to a DNA regulatory sequence that regulates expression of one or more genes in a plant when a transcription factor having one or more specific binding domains binds to the DNA regulatory sequence. Transcription factors of the present invention may possess, for example, an AP2 domain, in which case the AP2 domain of the transcription factor binds to a transcription regulating region, such as AtERF1, which binds to the motif AGCCGCC (the "GCC box") that are present in promoters of genes such as PDF1.2. The transcription factors of the invention also comprise an amino acid subsequence that forms a transcription activation domain that regulates expression of one or more abiotic stress tolerance genes in a plant when the transcription factor binds to the regulating region.

A "sample" with respect to a material containing nucleic acid molecules may comprise a bodily fluid; an extract from a cell, chromosome, organelle, or membrane isolated from a cell; genomic DNA, RNA, or cDNA in solution or bound to a substrate; a cell; a tissue; a tissue print; a forensic sample; and the like. In this context "substrate" refers to any rigid or semi-rigid support to which nucleic acid molecules or proteins are bound and includes membranes, filters, chips, slides, wafers, fibers, magnetic or nonmagnetic beads, gels, capillaries or other tubing, plates, polymers, and microparticles with a variety of surface forms including wells, trenches, pins, channels and pores. A substrate may also refer to a reactant in a chemical or biological reaction, or a substance acted upon (for example, by an enzyme).

Transcription Factors Modify Expression of Endogenous Genes

A transcription factor may include, but is not limited to, any polypeptide that can activate or repress transcription of a single gene or a number of genes. As one of ordinary skill in the art recognizes, transcription factors can be identified by the presence of a region or domain of structural similarity or identity to a specific consensus sequence or the presence of a specific consensus DNA-binding site or DNA-binding site motif (for example, in Riechmann et al. (2000) *Science* 290: 2105-2110).

Generally, the transcription factors encoded by the present sequences are involved in cell differentiation and proliferation and the regulation of growth. Accordingly, one skilled in the art would recognize that by expressing the present sequences in a plant, one may change the expression of autologous genes or induce the expression of introduced genes. By affecting the expression of similar autologous sequences in a plant that have the biological activity of the present sequences, or by introducing the present sequences into a plant, one may alter a plant's phenotype to one with improved traits related to drought stress, shade tolerance or C/N sensing. The sequences of the invention may also be used to transform a plant and introduce desirable traits not found in the wild-type cultivar or strain. Plants may then be selected for those that produce the most desirable degree of over- or under-expression of target genes of interest and coincident trait improvement.

The sequences of the present invention may be from any species, particularly plant species, in a naturally-occurring form or from any source whether natural, synthetic, semi-synthetic or recombinant. The sequences of the invention may also include fragments of the present amino acid sequences. Where "amino acid sequence" is recited to refer to an amino acid sequence of a naturally occurring protein molecule, "amino acid sequence" and like terms are not meant to limit the amino acid sequence to the complete native amino acid sequence associated with the recited protein molecule.

In addition to methods for modifying a plant phenotype by employing one or more polynucleotides and polypeptides of the invention described herein, the polynucleotides and polypeptides of the invention have a variety of additional uses. These uses include their use in the recombinant production (i.e., expression) of proteins; as regulators of plant gene expression, as diagnostic probes for the presence of complementary or partially complementary nucleic acids (including for detection of natural coding nucleic acids); as substrates for further reactions, for example, mutation reactions, PCR reactions, or the like; as substrates for cloning for example, including digestion or ligation reactions; and for identifying exogenous or endogenous modulators of the transcription factors. In many instances, a polynucleotide comprises a nucleotide sequence encoding a polypeptide (or protein) or a domain or fragment thereof. Additionally, the polynucleotide may comprise a promoter, an intron, an enhancer region, a polyadenylation site, a translation initiation site, 5' or 3' untranslated regions, a reporter gene, a selectable marker, or the like. The polynucleotide can be single-stranded or double-stranded DNA or RNA. The polynucleotide optionally comprises modified bases or a modified backbone. The polynucleotide can be, for example, genomic DNA or RNA, a transcript (such as an mRNA), a cDNA, a PCR product, a cloned DNA, a synthetic DNA or RNA, or the like. The polynucleotide can comprise a sequence in either sense or antisense orientations.

Expression of genes that encode transcription factors that modify expression of endogenous genes, polynucleotides, and proteins are well known in the art. In addition, transgenic plants comprising isolated polynucleotides encoding transcription factors may also modify expression of endogenous genes, polynucleotides, and proteins. Examples include Peng et al. (1997) *Genes Development* 11: 3194-3205, and Peng et al. (1999) *Nature,* 400: 256-261). In addition, many others have demonstrated that an *Arabidopsis* transcription factor expressed in an exogenous plant species elicits the same or very similar phenotypic response (for example, in Fu et al. (2001) *Plant Cell* 13: 1791-1802; Nandi et al. (2000) *Curr. Biol.* 10: 215-218; Coupland (1995) *Nature* 377: 482-483; and Weigel and Nilsson (1995) *Nature* 377: 482-500).

In another example, Mandel et al. (1992) *Cell* 71-133-143, and Suzuki et al. (2001) *Plant J.* 28: 409-418 teach that a transcription factor expressed in another plant species elicits the same or very similar phenotypic response of the endogenous sequence, as often predicted in earlier studies of *Arabidopsis* transcription factors in *Arabidopsis* (Mandel et al. (1992) supra; and Suzuki et al. (2001) supra). Other examples include Müller et al. (2001) *Plant J.* 28: 169-179; Kim et al. (2001) *Plant J.* 25: 247-259; Kyozuka and Shimamoto (2002) *Plant Cell Physiol.* 43: 130-135; Boss and Thomas (2002) *Nature,* 416: 847-850; He et al. (2000) *Transgenic Res.* 9: 223-227; and Robson et al. (2001) *Plant J.* 28: 619-631.

In yet another example, Gilmour et al. (1998) *Plant J.* 16: 433-442, teach an *Arabidopsis* AP2 transcription factor, CBF1, which, when overexpressed in transgenic plants, increases plant freezing tolerance. Jaglo et al. (2001) *Plant Physiol.* 127: 910-917, further identified sequences in *Brassica napus* which encode CBF-like genes and that transcripts for these genes accumulated rapidly in response to low temperature. Transcripts encoding CBF-like proteins were also found to accumulate rapidly in response to low temperature in wheat, as well as in tomato. An alignment of the CBF proteins from *Arabidopsis, B. napus*, wheat, rye, and tomato revealed the presence of conserved consecutive amino acid residues, PKK/RPAGRxKFxETRHP (SEQ ID NO: 1260) and DSAWR (SEQ ID NO: 1261), that bracket the AP2/EREBP DNA binding domains of the proteins and distinguish them from other members of the AP2/EREBP protein family (Jaglo et al. (2001) supra).

Transcription factors mediate cellular responses and control traits through altered expression of genes containing cis-acting nucleotide sequences that are targets of the introduced transcription factor. It is well appreciated in the art that the effect of a transcription factor on cellular responses or a cellular trait is determined by the particular genes whose expression is either directly or indirectly (for example, by a cascade of transcription factor binding events and transcriptional changes) altered by transcription factor binding. In a global analysis of transcription comparing a standard condition with one in which a transcription factor is overexpressed, the resulting transcript profile associated with transcription factor overexpression is related to the trait or cellular process controlled by that transcription factor. For example, the PAP2 gene (and other genes in the MYB family) have been shown to control anthocyanin biosynthesis through regulation of the expression of genes known to be involved in the anthocyanin biosynthetic pathway (Bruce et al. (2000) *Plant Cell,* 12: 65-79; Borevitz et al. (2000) *Plant Cell* 12: 2383-93). Further, global transcript profiles have been used successfully as diagnostic tools for specific cellular states (for example, cancerous vs. non-cancerous; Bhattacharjee et al. (2001) *Proc Natl. Acad. Sci.*, USA, 98: 13790-13795; Xu et al. (2001) *Proc. Natl. Acad. Sci.*, USA, 98: 15089-15094). Consequently, it is evident to one skilled in the art that similarity of transcript profile upon overexpression of different transcription factors would indicate similarity of transcription factor function.

Polypeptides and Polynucleotides of the Invention

The present invention provides, among other things, transcription factors (TFs), and transcription factor homolog polypeptides, and isolated or recombinant polynucleotides encoding the polypeptides, or novel sequence variant polypeptides or polynucleotides encoding novel variants of transcription factors derived from the specific sequences provided here.

The polynucleotides of the invention can be or were ectopically expressed in overexpressor plant cells and the changes in the expression levels of a number of genes, polynucleotides, and/or proteins of the plant cells observed. Therefore, the polynucleotides and polypeptides can be employed to change expression levels of a genes, polynucleotides, and/or proteins of plants or plant cells. These polypeptides and polynucleotides may be employed to modify a plant's characteristics, particularly drought tolerance, shade tolerance, and/or C/N sensing. The polynucleotides of the invention can be or were ectopically expressed in overexpressor or knockout plants and the changes in the characteristic(s) or trait(s) of the plants observed. Therefore, the polynucleotides and polypeptides can be employed to improve the characteristics of plants. The polypeptide sequences of the sequence listing have been shown to confer increased drought or shade tolerance or altered C/N sensing when these polypeptides are overexpressed in *Arabidopsis* plants. These polynucleotides have been shown to have a strong association with these traits, in that plants that overexpress these sequences are more tolerant to drought, shade, or have altered C/N sensing, respectively. The invention also encompasses a complement of the polynucleotides. The polynucleotides are also useful for screening libraries of molecules or compounds for specific binding and for creating transgenic plants having improved traits. Altering the expression levels of equivalogs of these sequences, including paralogs and orthologs in the Sequence Listing, and other orthologs that are structurally and sequentially similar to the former orthologs, has been shown and is expected to confer similar phenotypes, including altered C/N sensing, drought and/or shade tolerance in plants.

In some cases, exemplary polynucleotides encoding the polypeptides of the invention were identified in the *Arabidopsis thaliana* GenBank database using publicly available sequence analysis programs and parameters. Sequences initially identified were then further characterized to identify sequences comprising specified sequence strings corresponding to sequence motifs present in families of known transcription factors. In addition, further exemplary polynucleotides encoding the polypeptides of the invention were identified in the plant GenBank database using publicly available sequence analysis programs and parameters. Sequences initially identified were then further characterized to identify sequences comprising specified sequence strings corresponding to sequence motifs present in families of known transcription factors. Polynucleotide sequences meeting such criteria were confirmed as transcription factors.

Additional polynucleotides of the invention were identified by screening *Arabidopsis thaliana* and/or other plant cDNA libraries with probes corresponding to known transcription factors under low stringency hybridization conditions. Additional sequences, including full length coding sequences were subsequently recovered by the rapid amplification of cDNA ends (RACE) procedure, using a commercially available kit according to the manufacturer's instructions. Where necessary, multiple rounds of RACE are performed to isolate 5' and 3' ends. The full-length cDNA was then recovered by a routine end-to-end polymerase chain reaction (PCR) using primers specific to the isolated 5' and 3' ends. Exemplary sequences are provided in the Sequence Listing.

The polynucleotides are particularly useful when they are hybridizable array elements in a microarray. Such a microarray can be employed to monitor the expression of genes that are differentially expressed in response to limited light, drought, other osmotic stresses, or low nitrogen availability. The microarray can be used in large scale genetic or gene expression analysis of a large number of polynucleotides; or in the diagnosis of, for example, drought stress before phenotypic symptoms are evident. Furthermore, the microarray can be employed to investigate cellular responses, such as cell proliferation, transformation, and the like.

When the polynucleotides of the invention may also be used as hybridizable array elements in a microarray, the array elements are organized in an ordered fashion so that each element is present at a specified location on the substrate. Because the array elements are at specified locations on the substrate, the hybridization patterns and intensities (which together create a unique expression profile) can be interpreted in terms of expression levels of particular genes and can be correlated with a particular stress, pathology, or treatment.

The invention also entails an agronomic composition comprising a polynucleotide of the invention in conjunction with a suitable carrier and a method for altering a plant's trait using the composition.

Examples of specific polynucleotide and polypeptides of the invention, and equivalog sequences, along with descriptions of the gene families that comprise these polynucleotides and polypeptides, are provided below.

Examples of specific polynucleotide and polypeptides of the invention, and equivalog sequences, are provided below.

Polypeptide sequences of the sequence listing, including, for example, *Arabidopsis* sequences G2133, G1274, G922, G2999, G3086, G354, G1792, G2053, G975, G1069, G916, G1820, G2701, G47, G2854, G2789, G634, G175, G2839, G1452, G3083, G489, G303, G2992, and G682 (SEQ ID NOs: 12, 6, 4, 14, 16, 228, 8, 10, 238, 240, 236, 244, 246, 2, 252, 248, 232, 224, 250, 242, 254, 230, 226, 50 and 234, respectively) have been shown to confer increased drought tolerance when expression of these polypeptides is altered in *Arabidopsis* plants. These polynucleotides have been shown to have a strong association with drought stress tolerance, in that plants that overexpress these sequences are more tolerant to drought. Exemplary sequences of the invention include G2133, G47, and structurally and functionally-related sequences found in the G47 clade of transcription factor polypeptides (examples of which may be found in FIGS. 3 and 4).

A number of the polypeptide sequences of the sequence listing, including, for example, G682, G226, G1816, G2718, G24, G154, G384, G486, G545, G760, G773, G937, G971, G988, G989, G1069, G1090, G1322, G1587, G1666, G1700, G1818, G1868, G1888, G2117, G2131, G2520, G2522, G2789, G8, G27, G156, G161, G168, G183, G189, G200, G234, G237, G275, G326, G347, G427, G505, G590, G602, G618, G635, G643, G653, G657, G837, G866, G872, G904, G912, G932, G958, G964, G975, G979, G1049, G1246, G1255, G1266, G1331, G1332, G1494, G1535, G1649, G1750, G1773, G1835, G1930, G2053, G2057, G2133, G2144, G2145, G2295, G2512, G2531, G2535, G2590, and G2719 (SEQ ID NOs: 234, 286, 312, 324, 420, 422, 424, 294, 426, 428, 430, 432, 434, 436, 438, 240, 440, 442, 444, 446, 448, 450, 452, 454, 456, 458, 460, 462, 248, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 238, 524, 526, 528, 530, 532, 534, 536, 538, 540, 542, 544, 546, 548, 550, 10, 552, 12, 554, 556, 558, 560, 562, 564, 566, and 568, respectively) have been shown to confer altered C/N sensing when expression of these polypeptides is altered in *Arabidopsis* plants. A number of these polynucleotides have also been shown to confer increased tolerance to low nutrient (e.g., nitrogen-limited) environments and other abiotic stress tolerances such as drought, heat, and cold. Exemplary sequences of the invention include G682 and structurally and functionally-related sequences found in the G682 subclade (examples may be found in FIGS. 20A, 20B and 21).

A number of the polypeptide sequences of the sequence listing, including, for example, G634, G1048, G1100, G1412, G2505, G1796, G1995, G2467, G2550, G2640, G2686, and G2789 (SEQ ID NOs: 232, 808, 810, 658, 818, 812, 814, 816, 820, 822, 824 and 248, respectively) have also been shown to confer increased shade tolerance when expression of these polypeptides is altered in *Arabidopsis* plants. Equivalogs of these sequences, including paralogs and orthologs in the Sequence Listing, and other orthologs that are structurally and sequentially similar to the former orthologs, are expected to confer increased shade tolerance in plants when their expression is altered. Exemplary sequences of the invention include G634 and structurally and functionally-related sequences found in the G634 clade (examples of which may be found in Table 8).

The invention also encompasses the complements of these polynucleotides. The polynucleotides are also useful for screening libraries of molecules or compounds for specific binding and for creating transgenic plants having altered C/N sensing or increased abiotic stress or shade tolerance. Equivalogs of these sequences, including paralogs and orthologs in the Sequence Listing, and other orthologs that are structurally and sequentially similar to the former orthologs, are expected to confer altered C/N sensing and/or abiotic stress tolerance in plants when their expression is altered.

The AP2 Family, Including the G47/G2133 and G1792 Clades.

AP2 (APETALA2) and EREBPs (Ethylene-Responsive Element Binding Proteins) are the prototypic members of a family of transcription factors unique to plants, whose distinguishing characteristic is that they contain the so-called AP2 DNA-binding domain (Riechmann and Meyerowitz (1998) *Biol. Chem.* 379: 633-646). The AP2 domain was first recognized as a repeated motif within the *Arabidopsis thaliana* AP2 protein (Jofuku et al. (1994) *Plant Cell* 6: 1211-1225). Shortly afterwards, four DNA-binding proteins from tobacco were identified that interact with a sequence that is essential for the responsiveness of some promoters to the plant hormone ethylene, and were designated as ethylene-responsive element binding proteins (EREBPs; Ohme-Takagi et al. (1995) *Plant Cell* 7: 173-182). The DNA-binding domain of EREBP-2 was mapped to a region that was common to all four proteins (Ohme- Takagi et al (1995) supra), and that was found to be closely related to the AP2 domain (Weigel (1995) *Plant Cell* 7: 388-389) but that did not bear sequence similarity to previously known DNA-binding motifs.

AP2/EREBP genes form a large family, with many members known in several plant species (Okamuro et al. (1997) *Proc. Natl. Acad. Sci. USA* 94: 7076-7081; Riechmann and Meyerowitz (1998) supra). The number of AP2/EREBP genes in the *Arabidopsis thaliana* genome is approximately 145 (Riechmann et al. (2000) *Science* 290: 2105-2110). The APETALA2 class is characterized by the presence of two AP2 DNA binding domains, and contains 14 genes. The AP2/ERF is the largest subfamily, and includes 125 genes which are involved in abiotic (DREB subgroup) and biotic (ERF subgroup) stress responses and the RAV subgroup includes 6 genes which all have a B3 DNA binding domain in addition to the AP2 DNA binding domain (Kagaya et al. (1999) *Nucleic Acids Res.* 27: 470-478).

*Arabidopsis* AP2 is involved in the specification of sepal and petal identity through its activity as a homeotic gene that forms part of the combinatorial genetic mechanism of floral organ identity determination and it is also required for normal ovule and seed development (Bowman et al. (1991) *Development* 112: 1-20; Jofuku et al. (1994) supra). *Arabidopsis* ANT is required for ovule development and it also plays a role in floral organ growth (Elliott et al. (1996) *Plant Cell* 8: 155-168; Klucher et al. (1996) *Plant Cell* 8: 137-153). Finally, maize G115 regulates leaf epidermal cell identity (Moose et al. (1996) *Genes Dev.* 10: 3018-3027).

The attack of a plant by a pathogen may induce defense responses that lead to resistance to the invasion, and these responses are associated with transcriptional activation of defense-related genes, among them those encoding pathogenesis-related (PR) proteins. The involvement of EREBP-like genes in controlling the plant defense response is based on the observation that many PR gene promoters contain a short cis-acting element that mediates their responsiveness to ethylene (ethylene appears to be one of several signal molecules controlling the activation of defense responses). Tobacco EREBP-1, -2, -3, and -4, and tomato Pti4, Pti5 and Pti6 proteins have been shown to recognize such cis-acting elements (Ohme-Takagi (1995) supra; Zhou et al. (1997) *EMBO J.* 16: 3207-3218). In addition, Pti4, Pti5, and Pti6 proteins have been shown to directly interact with Pto, a protein kinase that confers resistance against *Pseudomonas syringae* pv tomato (Zhou et al. (1997) supra). Plants are also challenged by adverse environmental conditions like cold or drought, and EREBP-like proteins appear to be involved in the responses to these abiotic stresses as well. COR (for cold-regulated) gene expression is induced during cold acclimation, the process by which plants increase their resistance to freezing in response to low unfreezing temperatures. The *Arabidopsis* EREBP-like gene CBF1 (Stockinger et al. (1997) *Proc. Natl. Acad. Sci. USA* 94: 1035-1040) is a regulator of the cold acclimation response, because ectopic expression of CBF1 in *Arabidopsis* transgenic plants induced COR gene expression in the absence of a cold stimulus, and the plant freezing tolerance was increased (Jaglo-Ottosen et al. (1998) *Science* 280: 104-106). Finally, another *Arabidopsis* EREBP-like gene, ABI4, is involved in ABA signal transduction, because abi4 mutants are insensitive to ABA (ABA is a plant hormone that regulates many agronomically important aspects of plant development; Finkelstein et al. (1998) *Plant Cell* 10: 1043-1054).

Of the sequences examined to date, two valine residues were found that are present in members of the G47 clade but not outside of the clade (indicated by the arrows in FIG. 3). All members of the clade examined thus far have the subsequence:

V-(X)17-A-A-V-A-H-D-X-A (SEQ ID NO: 1262), where X is any amino acid and the identified residues are indicated by the residues shown in the boxes in FIG. 3.

The SCR Family, Including the G922 Clade.

The SCARECROW gene, which regulates an asymmetric cell division essential for proper radial organization of root cell layers, was isolated from *Arabidopsis thaliana* by screening a genomic library with sequences flanking a T-DNA insertion causing a "scarecrow" mutation (Di Laurenzio et al. (1996) *Cell* 86, 423-433). The gene product was tentatively described as a transcription factor based on the presence of homopolymeric stretches of several amino acids, the presence of a basic domain similar to that of the basic-leucine zipper family of transcription factors, and the presence of leucine heptad repeats. The presence of several *Arabidopsis* ESTs with gene products homologous to the SCARECROW gene were noted. The ability of the SCARECROW gene to complement the scarecrow mutation was also demonstrated (Malamy et al. (1997) *Plant J.* 12, 957-963).

More recently, the SCARECROW homologue RGA, which encodes a negative regulator of the gibberellin signal transduction pathway, was isolated from *Arabidopsis* by genomic subtraction (Silverstone et al. (1998) *Plant Cell* 10, 155-169). The RGA gene was shown to be expressed in many different tissues and the RGA protein was shown to be localized to the nucleus. The same gene was isolated by Truong (Truong et al. (1997) *FEBS Lett.* 410: 213-218) by identifying cDNA clones which complement a yeast nitrogen metabolism mutant, suggesting that RGA may be involved in regulating diverse metabolic processes. Another SCARECROW homologue designated GAI, which also is involved in gibberellin signaling processes, has been isolated by Peng (Peng et al. (1997) *Genes Dev.* 11, 3194-3205). Interestingly, GAI is the gene that initiated the Green Revolution. Peng et al. (Peng et al. (1999) Nature 6741, 256-261) have recently shown that maize GAI orthologs, when mutated, result in plants that are shorter, have increased seed yield, and are more resistant to damage by rain and wind than wild type plants. Based on the inclusion of the GAI, RGA and SCR genes in this family, it has also been referred to as the GRAS family (Pysh et al. (1999) *Plant J* 18, 111-19).

The scarecrow gene family has 32 members in the *Arabidopsis* genome.

The WRKY Family, Including the G1274 Clade.

The WRKY family of transcription factors is thus far only found in plants. It is primarily characterized by a 60 amino acid conserved DNA binding domain and a zinc finger domain. The family is divided into groups based on whether the protein has two or only one WRKY domain (Groups I and II, respectively), and further subdivided based on a unique variation of the zing finger motif (Group III) as described by Eulgem (Eulgem et al. (2000) *Trends Plant Science* 5:199-206). G1274 (polynucleotide SEQ ID NO: 5 and polypeptide SEQ ID NO: 6) belongs to the so-called Group II class of WRKY proteins, which can be further subdivided into 5 groups (a-e) based on conserved structural features outside of the WRKY domain. G1274 is a member of the IIc subgroup.

The phylogenetic tree in FIG. 17 uses other closely related members of the WRKY Group IIc family as a natural out-group to the G1274 clade. Using either the full protein, or WRKY domain, the potentially orthologous sequences shown on the tree appear most closely related to the G1274 paralog clade. FIG. 16 indicates amino acids within the WRKY domain that differentiate the G1274 clade from the out-group. Notable for the G1274 clade are the conserved K at position 264, the N at position 275, the S at position 280, and the F/Y at position 299 (indicated by arrows in FIG. 16). These residues are potentially responsible for the conserved structure/function of this clade with regard to drought tolerance. The G1274 domain may thus be distinguished by the subsequence:

RR-K-Y-G-K-K-$(X)_8$-R-N-Y-$(X)_2$-C-S-$(X)_5$-V-K-K-X-V-X-R-$(X)_6$-Y/F-V (SEQ ID NO: 1263).

Amino acid residues within the WRKY domain that distinguish the G1274 clade sequences, and are putatively responsible for conserved functionality, are indicated within the boxes in FIG. 16.

Based on full-length protein sequence, G1758 appears firmly in the G1274 clade. However, FIG. 16 shows that, within the WRKY domain, G1758 is intermediate between the out-group and the claimed sequences. These amino acid differences may represent specific changes that retain drought tolerance function, or possibly more finely delineate the key residues required for function.

The NAC Family, Including the G2053 Clade.

The NAC family is a group of transcription factors that share a highly conserved N-terminal domain of about 150 amino acids, designated the NAC domain (NAC stands for *Petunia*, NAM, and *Arabidopsis*, ATAF1, ATAF2 and CUC2). This is believed to be a novel domain that is present in both monocot and dicot plants but is absent from yeast and animal proteins. One hundred and twelve members of the NAC family have been identified in the *Arabidopsis* genome. The NAC class of proteins can be divided into at least two sub-families on the basis of amino acid sequence similarities within the NAC domain. One sub-family is built around the NAM and CUC2 (cup-shaped cotyledon) proteins whilst the other sub-family contains factors with a NAC domain similar to those of ATAF1 and ATAF2.

Thus far, little is known about the function of different NAC family members. This is surprising given that there are 113 members in *Arabidopsis*. However, NAM, CUC1 and CUC2 are thought to have vital roles in the regulation of embryo and flower development. In *Petunia*, nam mutant embryos fail to develop a shoot apical meristem (SAM) and have fused cotyledons. These mutants sometimes generate escape shoots that produce defective flowers with extra petals and fused organs. In *Arabidopsis*, the cuc1 and cuc2 mutations have somewhat similar effects, causing defects in SAM formation and the separation of cotyledons, sepals and stamens.

Although nam and cuc mutants exhibit comparable defects during embryogenesis, the penetrance of these phenotypes is much lower in cuc mutants. Functional redundancy of the CUC genes in *Arabidopsis* may explain this observation. In terms of the flower phenotype there are notable differences between nam and cuc mutants. Flowers of cuc mutants do not contain additional organs and the formation of sepals and stamens is most strongly affected. In nam mutants, by contrast, the flowers do carry additional organs and petal formation is more markedly affected than that of other floral organs. These apparent differences might be explained in two ways: the NAM and CUC proteins have been recruited into different roles in development of *Arabidopsis* and *Petunia* flowers. Alternatively, the proteins could share a common function between the two species, with the different mutant floral phenotypes arising from variations in the way other genes (that participate in the same developmental processes) are affected by defects in NAM or CUC.

A further gene from this family, NAP (NAC-like activated by AP3/PI) is also involved in flower development and is thought to influence the transition between cell division and cell expansion in stamens and petals. Overall, then, the NAC proteins mainly appear to regulate developmental processes.

The ZF-HD Family, Including the G2999 Clade.

Since their discovery in 1983, the homeobox genes (the name of which derives from the homeotic mutations that affect *Drosophila* development) have been found in all eukaryotes examined, including yeast, plants, and animals (McGinnis et al. (1984) *Nature* 308: 428-433; McGinnis et al. (1984) *Cell* 37: 403-408; Scott et al. (1984) *Proc. Natl. Acad. Sci. U.S.A.* 81: 4115-4119; Scott et al. (1989) *Biochim. Biophys. Acta.* 989, 25-48; Shepherd et al. (1984) *Nature* 310: 70-71; Gehring et al. (1987) *Science* 236: 1245-1252; Vollbrecht et al. (1991) *Nature* 350: 241-243; Ruberti et al. (1991) *EMBO J.* 10: 1787-1791; and Schena and Davis (1992) *Genes. Dev.* 7, 367-379. The homeobox (HB) is a conserved DNA stretch that encodes an approximate 61 amino acid region termed the homeodomain (HD). It is well demonstrated that homeodomain proteins are transcription factors, and that the homeodomain is responsible for sequence specific recognition and binding of DNA (Affolter et al. (1990) *Curr Opin Cell Biol.* 2: 485-495; Hayashi and Scott (1990) *Cell* 63: 883-894, and references therein). Genetic and structural analysis indicate that the homeodomain operates by fitting the most conserved of three α-helices, helix 3, directly into the major groove of the DNA (Hanes and Brent (1989) *Cell* 57: 1275-1283; Hanes and Brent (1991) *Science* 251: 426-430; Kissinger et al. (1990) *Cell* 63: 579-590; and Wolberger et al. (1991) *Cell* 67: 517-528). A general review on the homeobox genes is provided by Duboule, D. (1994). *Guidebook to the Homeobox Genes*. Oxford, Oxford University Press.

Homeobox genes play many important roles in the developmental processes of multicellular animals. In *Drosophila*, for example, a variety of these genes have functions in embryo development. Initially, they act maternally to establish anterior-posterior polarity. Later, homeobox genes are known to regulate the segmentation process, dorso-ventral differentiation, and control cell fate determination in the eye and nervous system (Scott et al. (1989) supra).

A large number of homeodomain proteins have now been identified in a range of higher plants (Burglin (1997) *Nucleic Acids Res.* 25: 4173-4180; Burglin (1998) *Dev. Genes Evol.* 208: 113-116), which are herein defined as the containing the 'classical' type of homeodomain (FIGS. 6A-6C). These exhibit many differences to animal homeodomain proteins outside the conserved domain, but all contain the signature WFXNX[RK] (SEQ ID NO: 1264; X=any amino acid, [RK] indicates either an R or K residue at this position) within the third helix. Data from the Genome Initiative indicate that there are around 90 *Arabidopsis* classical homeobox genes. These are now being implicated in the control of a wide range of different processes. In many cases, plant homeodomains are found in proteins in combination with additional regulatory motifs such as leucine zippers. Classical plant homeodomain proteins can be broadly categorized into the following different classes based on homologies within the family, and the presence of other types of domain: KNOX class I, KNOX class II, HD-BEL1, HD-ZIP class I, HD-ZIP class II, HD-ZIP class III, HD-ZIP class IV (GL2 like), PHD finger type, and WUSCHEL-like (Freeling and Hake (1985); *Genetics* 111: 617-634 Vollbrecht et al. (1991) supra; Schindler et al. (1993) *Plant J.* 4:137-150; Sessa et al. (1994)). In:

Puigdomenech P, Coruzzi G, (eds) *Molecular genetic analysis of plant development and metabolism*, pp. 411-426. Springer Verlag, Berlin; Kerstetter et al. (1994) *Plant Cell* 6: 1877-1887; Kerstetter et al. (1997) *Development* 124: 3045-3054; Burglin (1997) supra; Burglin (1998) supra; Schoof et al. (2000) *Cell* 100: 635-644).

Recently a novel class of proteins was discovered that contain a domain similar to the classical homeodomain, in combination with N-terminal zinc finger motifs, by Windhovel (Windhovel et al. (2001) *Plant Mol. Biol.* 45: 201-214), while studying the regulatory mechanisms responsible for the mesophyll specific expression of the C4 phosphoenolpyruvate gene of *Flavaria trinervia*. Using a yeast one-hybrid screen, these workers recovered five cDNA clones, which encoded proteins that were capable of specifically binding the promoter of the *Flavaria* C4 phosphoenolpyruvate gene, but not the promoter of a *Flavaria* C3 phosphoenolpyruvate gene. One-hybrid experiments and in vitro DNA binding studies were then used to confirm that these proteins specifically interact with the proximal region of the C4 phosphoenolpyruvate gene. Four of five clones [FtHB1 (GenBank accession Y18577), FbHB2 (GenBank accession Y18579), FbHB3 (GenBank accession Y18580), and FbHB4 (GenBank accession Y18581), (the fifth clone encoded a histone)] all encoded a novel type of protein that contained two types of highly conserved domains. At the C-termini, a region was apparent that had many of the features of a homeodomain, whereas at the N-termini, two putative zinc finger motifs were present. Yeast two-hybrid experiments were used to show that the zinc finger motifs are sufficient to confer homo and hetero-dimerization between the proteins, and mutagenesis experiments demonstrated that conserved cysteine residues within the motifs are essential for such dimerization. Given the presence of the potential homeodomain and zinc fingers, Windhovel (Windhovel et al. (2001) supra) named this new class of proteins as the ZF-HD group.

That four proteins of this type were identified in the above studies suggested that the family might have a specific role in establishing expression of the C4 phosphoenolpyruvate gene within mesophyll cells. However, database searches revealed that proteins of this class are also present in C3 species, indicating that they likely have additional roles outside of C4 photosynthesis (Windhovel et al. (2001) supra). In particular, the *Arabidopsis* genome encodes fourteen proteins of this type, but the functional analysis of these proteins has yet to be publicly reported.

Secondary structure analyses performed by Windhovel (Windhovel et al. (2001) supra) indicated that the putative homeodomains of the ZF-HD proteins contain three α-helices similar to those recognized in the classes of homeodomain already found in plants (Duboule (1994) supra). Interestingly, though, if full-length proteins of the ZF-HD group are blasted against databases, they do not preferentially align with the known classes of plant homeodomain proteins. Furthermore, a phylogenetic tree based on comparing the classical versus ZF-HD type homeodomains reveal that the latter occupy a distinct node of the tree (FIG. 8).

A careful examination of the ZF-HD proteins reveals a particular striking difference to the classical plant homeodomain. All of the 90 or so previously recognized plant homeodomain proteins contain the signature WFXNX[RK] (SEQ ID NO: 1264; X=any amino acid) within the third helix. However, the ZF-HD proteins all lack the invariant F residue in this motif and generally contain an M in its place. This structural distinction, combined with the presence of ZF motifs in other regions of the protein, could confer functional properties on ZF-HD proteins that are different to those found in other HD containing proteins.

Residues that may be used to identify the G2999 clade are shown in boxes in FIGS. 6A and 6B. As shown in FIGS. 6A and 6B, a number of amino acid residues may be used to identify G2999 clade members. Of the G2999 clade members examined to date, each is a ZF-HD polypeptide and comprises the consensus subsequence:

K-$(X)_{17}$-W-$(X)_{13-15}$-C-$(X)_{12}$-W-$(X)_2$-N-N/H-K (SEQ ID NO: 1265, 1266 or 1267), where X is any amino acid.

The HLH/MYC Family, Including the G3086 Clade.

The bHLH protein family is a group of transcription factors found in mammals and plants. The typical feature of this family of transcription factors is that they share a highly conserved approximately 50 amino acid DNA-binding domain. This domain consists of a basic region of 14 amino acids followed by a first helix, a loop region of seven amino acids and a second helix (Littlewood et al. (1994) *Prot. Profile* 1: 639-709). In plants, members of this family also share, besides the bHLH domain, a highly conserved 200 amino acid N-terminal domain. Functional analysis revealed that small deletions in the N-terminal domain inactivate the B protein, a member of bHLH protein family, in *Z. mays* (Goff et al. (1992) *Genes Dev.* 6: 864-875). It has also been shown that the N-terminal domain can interact with one of other transcription factors (Myb proteins) to regulate anthocyanin biosynthesis in *Z. mays* (Goff et al. (1992) supra).

In mammalian systems, members of this family have been shown to control development and differentiation of a variety of cell types. The bHLH proteins play essential roles in neurogenesis or neural development, and myogenesis (Littlewood et al. (1994) supra).

Plant bHLH proteins have been shown to play an important role in the regulation of anthocyanin biosynthesis, in the control of trichome development, in phytochrome signaling transduction pathway, and in the regulation of dehydration- and ABA-inducible gene expression. It has suggested that the R locus of maize is responsible for determining the temporal and spatial pattern of anthocyanin pigmentation in the plant. The R gene family consists of B, S, and Lc genes, which encode a transcription factor of the basic helix-loop-helix class (Goff et al. (1992) supra, Ludwig (1990) *Cell* 62: 849-851). A gene encoding a basic helix-loop-helix protein has been cloned as a phytochrome-interacting factor in a genetic screen for T-DNA-tagged *Arabidopsis* mutants as well as in a yeast two-hybrid screen. The protein functions as a positively-acting signaling intermediate (Halliday et al. (1999) *Proc. Natl. Acad. Sci.* USA. 96:5832-5837, Ni et al. (1998) *Cell* 95: 657-667). A new mutant, hfr1 (long hypocotyl in far-red) has been isolated from Quail's lab. The hfr1 mutant exhibits a reduction in seedling responsiveness specifically to continuous far-red light (FRc), thereby suggesting a locus likely to be involved in phytochrome A (phyA) signal transduction. HFR1 encodes a nuclear protein with strong similarity to the bHLH family of DNA-binding proteins but with an atypical basic region. In contrast to PIF3, a related bHLH protein previously shown to bind phyB, HFR1 did not bind either phyA or B. However, HFR1 did bind PIF3, suggesting heterodimerization, and both the HFR1/PIF3 complex and PIF3 homodimer bound preferentially to the Pfr form of both phytochromes. Thus, HFR1 may function to modulate phyA signaling via heterodimerization with PIF3. HFR1 mRNA is 30-fold more abundant in FRc than in continuous red light, suggesting a potential mechanistic basis for the specificity of HFR1 to phyA signaling.

The rd22BP1 protein of *Arabidopsis* has a typical DNA-binding domain of a basic region helix-loop-helix motif. It has been shown that transcription of the rd22BP1 gene is induced by dehydration stress and phytohormone ABA treatment, and its induction precedes that of rd22, a dehydration-responsive gene (Abe et al. (1997) *Plant Cell* 9: 1859-1868).

Plant bHLH proteins may also play a crucial role in the process of nitrogen fixation, probably not acting as a transcription factor. A protein with a helix-loop-helix motif was identified as a symbiotic ammonium transport protein by functional complementation of the yeast $NH_4+$ transport mutant with a soybean nodule cDNA (Kaiser et al. (1998) *Science* 1998 281: 1202-1206). Using similar complementation approach of the yeast fet3fet4 mutant strain, an iron transport protein was isolated from an iron-deficient maize root cDNA expression library. The protein had 44% identity with an *Arabidopsis* bHLH-like protein RAP1 that binds the G-box sequence via a basic region helix-loop-helix (Loulergue (1998) *Gene* 225:47-57).

Another bHLH gene has been recently identified as ind1 (Liljegren et al. (2000) in 11th International Conference on *Arabidopsis* Research, Madison, Wis.; TAIR Accession Publication No. 1547039). They found that fruit from a knock-out mutant do not show dehiscence zone differentiation. In addition, their results suggest that ind1 may mediate cell differentiation during *Arabidopsis* fruit development. A cytokinin-repressed gene CRR12 with a basic region/helix-loop-helix motif was identified from a cucumber cotyledon cDNA library. It was found that the level of CRR12 transcripts decreased in response to either cytokinins or light in etiolated cotyledons. The mRNA was low in cotyledons and leaves of light-grown plants, but it increased during dark incubation.

As shown in FIG. 12, a number of amino acid residues may be used to identify G3086 clade members. Of the G3086 clade members examined to date, each of their sequences comprise the consensus subsequence: K-$(X)_5$-H-X-R-S-I-A-X-R-X-R-R-T-R/K-I-$(X)_6$-L-$(X)_2$-L-X-P-$(X)_2$-D-K-Q-T-$(X)_{4-5}$-M-$(X)_8$-K-X-L-Q (SEQ ID NOs: 1268 or 1269), where X is any amino acid.

Table 1 shows exemplary sequences of the invention that, in many cases, confer drought tolerance when overexpressed. The polypeptides are identified by polypeptide SEQ ID NO and Identifier (for example, Gene ID (GID) No., accession number or other name), presented in order of similarity to the first *Arabidopsis* sequence listed for each set, and includes the conserved domains of the polypeptide in amino acid coordinates, the respective domain sequences, and the extent of identity in percentage terms to the first *Arabidopsis* sequence listed for each set.

TABLE 1

Gene families and binding domains for exemplary sequences conferring drought tolerance, including paralogs and orthologs

| SEQ ID NO: | GID | Species | Conserved Domains in Polypeptide Amino Acid Coordinates | Conserved Domains in Polynucleotide Base Coordinates | Conserved Domain Sequence | SEQ ID NO: of conserved domain | % ID in conserved domain |
|---|---|---|---|---|---|---|---|
| | | | | | | | % ID to G2133 |
| 12 | G2133 | *Arabidopsis thaliana* | AP2: 10-77 | AP2: 53-256 | DQSKYKGIRRRKWGKW VSEIRVPGTRQRLWLGSF STAEGAAVAHDVAFYCL HRPSSLDDESFNFPHLL | 1270 | 100% |
| 94 | G3646 | *Brassica oleracea* | AP2: 10-77 | AP2: 203-406 | HQAKYKGIRRRKWGKW VSEIRVPATRERLWLGSF STAEGAAVAHDVAFYCL HRPSSLDNEAFNFPHLL | 1271 | 91% |
| 92 | G3645 | *Brassica rapa subsp. Pekinensis* | AP2: 10-75 | AP2: 40-237 | TQSKYKGIRRRKWGKW VSEIRVPGTRDRLWLGSF STAEGAAVAHDVAFYCL HQPNSLESLNFPHLL | 1272 | 89% |
| 2 | G47 | *Arabidopsis thaliana* | AP2: 10-75 | AP2: 65-262 | SQSKYKGIRRRKWGKWV SEIRVPGTRDRLWLGSFS TAEGAAVAHDVAFFCLH QPDSLESLNFPHLL | 1273 | 88% |
| 88 | G3643 | *Glycine max* | AP2: 13-78 | AP2: 101-298 | TNNKLKGVRRRKWGKW VSEIRVPGTQERLWLGTY ATPEAAAVAHDVAVYCL SRPSSLDKLNFPETL | 1274 | 69% |
| 96 | G3647 | *Zinnia elegans* | AP2: 13-78 | AP2: 53-250 | SQKTYKGVRCRRWGKW VSEIRVPGSRERLWLGTY STPEGAAVAHDVASYCL KGNTSFHKLNIPSML | 1275 | 63% |
| 90 | G3644 | *Oryza sativa (japonica cultivar-group)* | AP2: 52-122 | AP2: 154-366 | ERCRYRGVRRRRWGKW VSEIRVPGTRERLWLGSY ATPEAAAVAHDTAVYFL RGGAGDGGGGGATLNFP ERA | 1276 | 54% |

TABLE 1 -continued Gene families and binding domains for exemplary sequences conferring drought tolerance, including paralogs and orthologs

| SEQ ID NO: | GID | Species | Conserved Domains in Polypeptide Amino Acid Coordinates | Conserved Domains in Polynucleotide Base Coordinates | Conserved Domain Sequence | SEQ ID NO: of conserved domain | % ID in conserved domain |
|---|---|---|---|---|---|---|---|
| 98 | G3649 | Oryza sativa (japonica cultivar-group) | AP2: 15-87 | AP2: 43-261 | EMMRYRGVRRRRWGK WVSEIRVPGTRERLWLGS YATAEAAAVAHDAAVC LLRLGGGRRAAAGGGGG LNFPARA | 1277 | 53% |
| 100 | G3651 | Oryza sativa (japonica cultivar-group) | AP2: 60-130 | AP2: 178-390 | ERCRYRGVRRRRWGKW VSEIRVPGTRERLWLGSY ATPEAAAVAHDTAVYFL RGGAGDGGGGATAQLP GAR | 1278 | 52% |

| | | | | | | | % ID to G922 |
|---|---|---|---|---|---|---|---|
| 4 | G922 | Arabidopsis thaliana | 1st SCR: 134-199 | 1st SCR: 400-597 | RRLFFEMFPILKVSYLLT NRAILEAMEGEKMVHVI DLDASEPAQWLALLQAF NSRPEGPPHLRITG | 1279 | 100% |
| 4 | G922 | Arabidopsis thaliana | 2nd SCR: 332-401 | 2nd SCR: 994-1203 | FLNAIWGLSPKVMVVTE QDSDHNGSTLMERLLESL YTYAALFDCLETKVPRTS QDRIKVEKMLFGEEIKN | 1280 | 100% |
| 4 | G922 | Arabidopsis thaliana | 3rd SCR: 405-478 | 3rd SCR: 1213-1434 | CEGFERRERHEKLEKWS QRIDLAGFGNVPLSYYA MLQARRLLQGCGFDGYR IKEESGCAVICWQDRPLY SVSAW | 1281 | 100% |
| 220 | G3824 | Lycopersicon esculentum | 1st SCR: 42-107 | 1st SCR: 134-331 | RKMFFEIFPPFLKVAFVVT NQAIIEAMEGEKMVHIVD LNAAEPLQWRALLQDLS ARPEGPPHLRITG | 1282 | 69% |
| 220 | G3824 | Lycopersicon esculentum | 2nd SCR: 235-304 | 2nd SCR: 713-922 | FLNALWGLSPKVMVVTE QDANHNGTTLMERLSES LHFYAALFDCLESTLPRT SLERLKVEKMLLGEEIRN | 1283 | 78% |
| 220 | G3824 | Lycopersicon esculentum | 3rd SCR: 308-381 | 3rd SCR: 932-1153 | CEGIERKERHEKLEKWFQ RFDTSGFGNVPLSYYAM LQARRLLQSYSCEGYKIK EDNGCVVICWQDRPLFS VSSW | 1284 | 77% |
| 212 | G3810 | Glycine max | 1st SCR: 106-171 | 1st SCR: 316-513 | QKLFFELFPFLKVAFVLT NQAIIEAMEGEKVIHIIDL NAAEAAQWIALLRVLSA HPEGPPHLRITG | 1285 | 68% |
| 212 | G3810 | Glycine max | 2nd SCR: 305-374 | 2nd SCR: 913-1122 | FLNALWGLSPKVMVVTE QDCNHNGPTLMDRLLEA LYSYAALFDCLESTVSRT SLERLRVEKMLFGEEIKN | 1286 | 80% |
| 212 | G3810 | Glycine max | 3rd SCR: 378-451 | 3rd SCR: 1132-1353 | CEGSERKERHEKLEKWF QRFDLAGFGNVPLSYFG MVQARRFLQSYGCEGYR MRDENGCVLICWEDRPM YSISAW | 1287 | 71% |
| 214 | G3811 | Glycine max | 1st SCR: 103-168 | 1st SCR: 361-558 | QKLFFELLPFLKFSYILTN QAIVEAMEGEKMVHIVD LYGAGPAQWISLLQVLS ARPEGPPHLRITG | 1288 | 68% |

TABLE 1 -continued

Gene families and binding domains for exemplary sequences conferring drought tolerance, including paralogs and orthologs

| SEQ ID NO: | GID | Species | Conserved Domains in Polypeptide Amino Acid Coordinates | Conserved Domains in Polynucleotide Base Coordinates | Conserved Domain Sequence | SEQ ID NO: of conserved domain | % ID in conserved domain |
|---|---|---|---|---|---|---|---|
| 214 | G3811 | Glycine max | 2nd SCR: 296-365 | 2nd SCR: 940-1149 | FLNALWGLSPKVMVVTE QDFNHNCLTMMERLAEA LFSYAAYFDCLESTVSRA SMDRLKLEKMLFGEEIK N | 1289 | 74% |
| 214 | G3811 | Glycine max | 3rd SCR: 369-442 | 3rd SCR: 1159-1380 | CEGCERKERHEKMDRWI QRLDLSGFANVPISYYGM LQGRRFLQTYGCEGYKM REECGRVMICWQERSLFS ITAW | 1290 | 60% |
| 218 | G3814 | Oryza sativa (japonica cultivar-group) | 1st SCR: 123-190 | 1st SCR: 367-570 | RRHMFDVLPFLKLAYLT TNHAILEAMEGERFVHV VDFSGPAANPVQWIALF HAFRGRREGPPHLRITA | 1291 | 60% |
| 218 | G3814 | Oryza sativa (japonica cultivar-group) | 2nd SCR: 332-400 | 2nd SCR: 994-1200 | FLSAVRSLSPKIMVMTEQ EANHNGGAFQERFDEAL NYYASLFDCLQRSAAAA AERARVERVLLGEEIRG | 1292 | 48% |
| 218 | G3814 | Oryza sativa (japonica cultivar-group) | 3rd SCR: 404-480 | 3rd SCR: 1210-1440 | CEGAERVERHERARQWA ARMEAAGMERVGLSYSG AMEARKLLQSCGWAGP YEVRHDAGGHGFFFCWH KRPLYAVTAW | 1293 | 46% |
| 216 | G3813 | Oryza sativa (japonica cultivar-group) | 1st SCR: 129-194 | 1st SCR: 385-582 | RRHFLDLCPFLRLAGAAA NQSILEAMESEKIVHVIDL GGADATQWLELLHLLAA RPEGPPHLRLTS | 1294 | 53% |
| 216 | G3813 | Oryza sativa (japonica cultivar-group) | 2nd SCR: 290-359 | 2nd SCR: 868-1077 | FLGALWGLSPKVMVVAE QEASHNAAGLTERFVEA LNYYAALFDCLEVGAAR GSVERARVERWLLGEEIK N | 1295 | 61% |
| 216 | G3813 | Oryza sativa (japonica cultivar-group) | 3rd SCR: 363-436 | 3rd SCR: 1087-1308 | CDGGERRERHERLERWA RRLEGAGFGRVPLSYYA LLQARRVAQGLGCDGFK VREEKGNFFLCWQDRAL FSVSAW | 1296 | 64% |
| 222 | G3827 | Oryza sativa (japonica cultivar-group) | 2nd SCR: 226-295 | 2nd SCR: 676-885 | DVESLRGLSLKVMVVTE QEVSHNAAGLTERFVEA LNYYAALFDCLEVGGAR GSVERTRVERWELGEEIK N | 1297 | 55% |
| 222 | G3827 | Oryza sativa (japonica cultivar-group) | 3rd SCR: 299-365 | 3rd SCR: 895-1095 | CDGGERRERHERLEGAG FGRVPLSYYALLQARRV AQGLGCDGFKVREEKGN FELCWQDRALFSVSAW | 1298 | 60% |

| | | | | | | | % ID to G1274 |
|---|---|---|---|---|---|---|---|
| 6 | G1274 | Arabidopsis thaliana | WRKY: 110-166 | WRKY: 328-498 | DDGFKWRKYGKKSVKN NINKRNYYKCSSEGCSVK KRVERDGDDAAYVITTY EGVHNH | 1299 | 100% |
| 140 | G3724 | Glycine max | WRKY: 107-163 | WRKY: 390-560 | DDGYKWRKYGKKSVKS SPNLRNYYKCSSGGCSV KKRVERDRDDYSYVITT YEGVHNH | 1300 | 84% |

TABLE 1 -continued

Gene families and binding domains for exemplary sequences conferring drought tolerance, including paralogs and orthologs

| SEQ ID NO: | GID | Species | Conserved Domains in Polypeptide Amino Acid Coordinates | Conserved Domains in Polynucleotide Base Coordinates | Conserved Domain Sequence | SEQ ID NO: of conserved domain | % ID in conserved domain |
|---|---|---|---|---|---|---|---|
| 148 | G3728 | Zea mays | WRKY: 108-164 | WRKY: 1075-1245 | DDGFKWRKYGKKAVKN SPNPRNYYRCSSEGCGVK KRVERDRDDPRYVITTY DGVHNH | 1301 | 82% |
| 206 | G3802 | Sorghum bicolor | WRKY: 110-166 | WRKY: 386-556 | DDGFKWRKYGKKAVKN SPNPRNYYRCSSEGCGVK KRVERDRDDPRYVITTY DGVHNH | 1302 | 82% |
| 210 | G3804 | Zea mays | WRKY: 108-164 | WRKY: 438-608 | DDGFKWRKYGKKAVKN SPNPRNYYRCSSEGCGVK KRVERDRDDPRYVITTY DGVHNH | 1303 | 82% |
| 146 | G3727 | Zea mays | WRKY: 102-158 | WRKY: 391-561 | DDGFKWRKYGKKAVKS SPNPRNYYRCSSEGCGVK KRVERDRDDPRYVITTY DGVHNH | 1304 | 80% |
| 154 | G3731 | Lycopersicon esculentum | WRKY: 95-151 | WRKY: 297-467 | DDGFKCRKYGKKMVKN NPNPRNYYKCSSGGCNV KKRVERDNKDSSYVITTY EGIHNH | 1305 | 80% |
| 156 | G3732 | Solanum tuberosum | WRKY: 95-151 | WRKY: 309-479 | DDGFKWRKYGKKMVKN SSNPRNYYKCSSGGCNV KKRVERDNEDSSYVITTY EGIHNH | 1306 | 80% |
| 158 | G3733 | Hordeum vulgare | WRKY: 131-187 | WRKY: 641-811 | DDGYKWRKYGKKSVKN SPNPRNYYRCSTEGCSVK KRVERDRDDPAYVVTTY EGTHSH | 1307 | 80% |
| 204 | G3797 | Lactuca sativa | WRKY: 118-174 | WRKY: 363-533 | DDGFKWRKYGKKMVKN SPNPRNYYRCSAAGCSV KKRVERDVEDARYVITT YEGIHNH | 1308 | 80% |
| 208 | G3803 | Glycine max | WRKY: 111-167 | WRKY: 367-537 | DDGYKWRKYGKKTVKN NPNPRNYYKCSGEGCNV KKRVERDRDDSNYVLTT YDGVHNH | 1309 | 80% |
| 132 | G3720 | Zea mays | WRKY: 135-191 | WRKY: 403-573 | DDGYKWRKYGKKSVKN SPNPRNYYRCSTEGCNV KKRVERDKDDPSYVVTT YEGMHNH | 1310 | 78% |
| 134 | G3721 | Oryza sativa (japonica cultivar-group) | WRKY: 96-152 | WRKY: 342-512 | DDGEKWRKYGKKAVKN SPNPRNYYRCSTEGCNV KKRVERDREDHRYVITT YDGVHNH | 1311 | 78% |
| 136 | G3722 | Zea mays | WRKY: 129-185 | WRKY: 430-600 | DDGYKWRKYGKKSVKN SPNPRNYYRCSTEGCNV KKRVERDRDDPRYVVTM YEGVHNH | 1312 | 78% |
| 144 | G3726 | Oryza sativa (japonica cultivar-group) | WRKY: 135-191 | WRKY: 459-629 | DDGYKWRKYGKKSVKN SPNPRNYYRCSTEGCNV KKRVERDKDDPSYVVTT YEGTHNH | 1313 | 78% |
| 202 | G3795 | Capsicum annuum | WRKY: 95-151 | WRKY: 302-472 | DDGYKWRKYGKKMVK NSPNPRNYYRCSVEGCPV KKRVERDKEDSRYVITTY EGVHNH | 1314 | 78% |

TABLE 1 -continued

Gene families and binding domains for exemplary sequences conferring drought tolerance, including paralogs and orthologs

| SEQ ID NO: | GID | Species | Conserved Domains in Polypeptide Amino Acid Coordinates | Conserved Domains in Polynucleotide Base Coordinates | Conserved Domain Sequence | SEQ ID NO: of conserved domain | % ID in conserved domain |
|---|---|---|---|---|---|---|---|
| 30 | G1275 | Arabidopsis thaliana | WRKY: 113-169 | WRKY: 394-564 | DDGFKWRKYGKKMVKN SPHPRNYYKCSVDGCPV KKRVERDRDDPSFVITTY EGSHNH | 1315 | 77% |
| 138 | G3723 | Glycine max | WRKY: 113-169 | WRKY: 715-885 | DDGYKWRKYGKKTVKS SPNPRNYYKCSGEGCDV KKRVERDRDDSNYVLTT YDGVHNH | 1316 | 77% |
| 152 | G3730 | Oryza sativa (japonica cultivar-group) | WRKY: 107-163 | WRKY: 385-555 | DDGFKWRKYGKKAVKS SPNPRNYYRCSAAGCGV KKRVERDGDDPRYVVTT YDGVHNH | 1317 | 77% |
| 130 | G3719 | Zea mays | WRKY: 91-147 | WRKY: 428-598 | DDGFKWRKYGKKAVKS SPNPRNYYRCSTEGSGVK KRVERDSDDPRYVVTTY DGVHNH | 1318 | 75% |
| 142 | G3725 | Oryza sativa (japonica cultivar-group) | WRKY: 158-214 | WRKY: 688-858 | DDGYKWRKYGKKSVKN SPNPRNYYRCSTEGCNV KKRVERDKNDPRYVVT MYEGIHNH | 1319 | 75% |
| 150 | G3729 | Oryza sativa (japonica cultivar-group) | WRKY: 137-193 | WRKY: 452-622 | DDGYRWRKYGKKMVKN SPNPRNYYRCSSEGCRVK KRVERARDDARFVVTTY DGVHNH | 1320 | 75% |
| 32 | G1758 | Arabidopsis thaliana | WRKY: 109-165 | WRKY: 393-563 | DDGYKWRKYGKKPITGS PFPRHYHKCSSPDCNVKK KIERDTNNPDYILTTYEG RHNH | 1321 | 57% |

| | | | | | | | % ID to G1792 |
|---|---|---|---|---|---|---|---|
| 8 | G1792 | Arabidopsis thaliana | AP2: 16-80 | AP2: 122-316 | KQARFRGVRRRPWGKFA AEIRDPSRNGARLWLGTF ETAEEAARAYDRAAFNL RGHLAILNFPNEY | 1322 | 100% |
| 86 | G3520 | Glycine max | AP2: 14-78 | AP2: 50-244 | EEPRYRGVRRRPWGKFA AEIRDPARHGARVWLGT FLTAEEAARAYDRAAYE MRGALAVLNFPNEY | 1323 | 80% |
| 82 | G3518 | Glycine max | AP2: 13-77 | AP2: 134-328 | VEVRYRGIRRRPWGKFA AEIRDPTRKGTRIWLGTF DTAEQAARAYDAAAFHF RGHRAILNFPNEY | 1324 | 76% |
| 84 | G3519 | Glycine max | AP2: 13-77 | AP2: 93-287 | CEVRYRGIRRRPWGKFA AEIRDPTRKGTRIWLGTF DTAEQAARAYDAAAFHF RGHRAILNFPNEY | 1325 | 76% |
| 160 | G3735 | Medicago truncatula | AP2: 23-87 | AP2: 148-342 | DQIKYRGIRRRPWGKFA AEIRDPTRKGTRIWLGTF DTAEQAARAYDAAAFHF RGHRAILNFPNEY | 1326 | 76% |
| 34 | G1791 | Arabidopsis thaliana | AP2: 10-74 | AP2: 63-257 | NEMKYRGVRKRPWGKY AAEIRDSARHGARVWLG TFNTAEDAARAYDRAAF GMRGQRAILNFPHEY | 1327 | 72% |

TABLE 1 -continued

Gene families and binding domains for exemplary sequences conferring drought tolerance, including paralogs and orthologs

| SEQ ID NO: | GID | Species | Conserved Domains in Polypeptide Amino Acid Coordinates | Conserved Domains in Polynucleotide Base Coordinates | Conserved Domain Sequence | SEQ ID NO: of conserved domain | % ID in conserved domain |
|---|---|---|---|---|---|---|---|
| 70 | G3380 | Oryza sativa (japonica cultivar-group) | AP2: 18-82 | AP2: 138-332 | ETTKYRGVRRRPSGKFA AEIRDSSRQSVRVWLGTF DTAEEAARAYDRAAYA MRGHLAVLNFPAEA | 1328 | 72% |
| 74 | G3383 | Oryza sativa (japonica cultivar-group) | AP2: 9-73 | AP2: 25-219 | TATKYRGVRRRPWGKFA AEIRDPERGGARVWLGT FDTAEEAARAYDRAAYA QRGAAAVLNFPAAA | 1329 | 72% |
| 18 | G30 | Arabidopsis thaliana | AP2: 16-80 | AP2: 86-280 | EQGKYRGVRRRPWGKY AAEIRDSRKHGERVWLG TFDTAEDAARAYDRAAY SMRGKAAILNFPHEY | 1330 | 70% |
| 72 | G3381 | Oryza sativa (japonica cultivar-group) | AP2: 14-78 | AP2: 122-316 | LVAKYRGVRRRPWGKFA AEIRDSSRHGVRVWLGTF DTAEEAARAYDRSAYSM RGANAVLNFPADA | 1331 | 70% |
| 76 | G3515 | Oryza sativa (japonica cultivar-group) | AP2: 11-75 | AP2: 53-247 | SSSSYRGVRKRPWGKFA AEIRDPERGGARVWLGT FDTAEEAARAYDRAAFA MKGATAMLNFPGDH | 1332 | 70% |
| 78 | G3516 | Zea mays | AP2: 6-70 | AP2: 16-210 | KEGKYRGVRKRPWGKF AAEIRDPERGGSRVWLG TFDTAEEAARAYDRAAF AMKGATAVENFPASG | 1333 | 70% |
| 164 | G3737 | Oryza sativa (japonica cultivar-group) | AP2: 8-72 | AP2: 233-427 | AASKYRGVRRRPWGKFA AEIRDPERGGSRVWLGTF DTAEEAARAYDRAAFAM KGAMAVENFPGRT | 1334 | 70% |
| 36 | G1795 | Arabidopsis thaliana | AP2: 11-75 | AP2: 57-251 | EHGKYRGVRRRPWGKY AAEIRDSRKHGERVWLG TFDTAEEAARAYDQAAY SMRGQAAILNFPHEY | 1335 | 69% |
| 200 | G3794 | Zea mays | AP2: 6-70 | AP2: 135-329 | EPTKYRGVRRRPSGKFA AEIRDSSRQSVRMWLGTF DTAEEAARAYDRAAYA MRGQIAVENFPAEA | 1336 | 69% |
| 80 | G3517 | Zea mays | AP2: 13-77 | AP2: 76-270 | EPTKYRGVRRRPWGKYA AEIRDSSRHGVRIWLGTF DTAEEAARAYDRSANSM RGANAVLNFPEDA | 1337 | 67% |
| 162 | G3736 | Triticum aestivum | AP2: 12-76 | AP2: 163-357 | EPTKYRGVRRRPWGKFA AEIRDSSRHGVRMWLGT FDTAEEAAAAYDRSAYS MRGRNAVLNFPDRA | 1338 | 67% |
| 166 | G3739 | Zea mays | AP2: 13-77 | AP2: 211-405 | EPTKYRGVRRRPWGKYA AEIRDSSRHGVRIWLGTF DTAEEAARAYDRSAYSM RGANAVLNFPEDA | 1339 | 67% |
| | | | | | | | % ID to G2053 |
| 10 | G2053 | Arabidopsis thaliana | NAC: 6-152 | NAC: 16-456 | GLRFRPTDKEIVVDYLRP KNSDRDTSHVDRVISTVT IRSFDPWELPCQSRIKLKD ESWCFFSPKENKYGRGD QQIRKTKSGYWKITGKPK PILRNRQEIGEKKVLMFY MSKELGGSKSDWVMHE | 1340 | 100% |

TABLE 1-continued

Gene families and binding domains for exemplary sequences conferring drought tolerance, including paralogs and orthologs

| SEQ ID NO: | GID | Species | Conserved Domains in Polypeptide Amino Acid Coordinates | Conserved Domains in Polynucleotide Base Coordinates | Conserved Domain Sequence | SEQ ID NO: of conserved domain | % ID in conserved domain |
|---|---|---|---|---|---|---|---|
| | | | | | YHAFSPTQMMMTYTICK VMFKGD | | |
| 20 | G515 | Arabidopsis thaliana | NAC: 6-149 | NAC: 93-524 | GLRFCPTDEEIVVDYLWP KNSDRDTSHVDRFINTVP VCRLDPWELPCQSRIKLK DVAWCFFRPKENKYGRG DQQMRKTKSGFWKSTGR PKPIMRNRQQIGEKKILM FYTSKESKSDWVIHEYHG FSHNQMMMTYTLCKVM FNGG | 1341 | 78% |
| 24 | G517 | Arabidopsis thaliana | NAC: 6-153 | NAC: 16-459 | GFRFRPNDEEIVDHYLRP KNLDSDTSHVDEVISTVD ICSFEPWDLPSKSMIKSRD GVWYFFSVKEMKYNRG DQQRRRTNSGFWKKTGK TMTVMRKRGNREKIGEK RVLVFKNRDGSKTDWV MHEYHATSLFPNQMMTY TVCKVEFKGE | 1342 | 62% |
| 22 | G516 | Arabidopsis thaliana | NAC: 6-141 | NAC: 16-423 | GFRFRPTDGEIVDIYLRPK NLESNTSHVDEVISTVDIC SFDPWDLPSHSRMKTRD QVWYFFGRKENKYGKG DRQIRKTKSGFWKKTGV TMDIMRKTGDREKIGEK RVLVFKNHGGSKSDWA MHEYHATFSSPNQGE | 1343 | 55% |

| | | | | | | | % ID to G2999 |
|---|---|---|---|---|---|---|---|
| 14 | G2999 | Arabidopsis thaliana | ZF: 80-133 | ZF: 280-441 | ARYRECQKNHAASSGGH VVDGCGEFMSSGEEGTV ESLLCAACDCHRSFHRKE ID | 1344 | 100% |
| 14 | G2999 | Arabidopsis thaliana | HB: 198-261 | HB: 634-825 | KKRFRTKFNEEQKEKMM EFAEKIGWRMTKLEDDE VNRFCREIKVKRQVFKV WMHNNKQAAKKKD | 1345 | 100% |
| 62 | G2998 | Arabidopsis thaliana | ZF: 74-127 | ZF: 220-381 | VRYRECLKNHAASVGGS VHDGCGEFMPSGEEGTIE ALRCAACDCHRNFHRKE MD | 1346 | 79% |
| 62 | G2998 | Arabidopsis thaliana | HB: 240-303 | HB: 718-909 | KKRFRTKFTTDQKERMM DFAEKLGWRMNKQDEE ELKRFCGEIGVKRQVFKV WMHNNKNNAKKPP | 1347 | 78% |
| 64 | G3000 | Arabidopsis thaliana | ZF: 58-111 | ZF: 318-479 | AKYRECQKNHAASTGGH VVDGCCEFMAGGEEGTL GALKCAACNCHRSFHRK EVY | 1348 | 77% |
| 64 | G3000 | Arabidopsis thaliana | HB: 181-244 | HB: 687-878 | KKRVRTKINEEQKEKMK EFAERLGWRMQKKDEEE IDKFCRMVNLRRQVFKV WMHNNKQAMKRNN | 1349 | 65% |
| 106 | G3670 | Lotus corniculatus var. japonicus | ZF: 62-115 | ZF: 184-345 | VRYRECQKNHAVSFGGH AVDGCCEFMAAGDEGTL EAVICAACNCHRNFHRK EID | 1350 | 74% |

TABLE 1-continued

Gene families and binding domains for exemplary sequences conferring drought tolerance, including paralogs and orthologs

| SEQ ID NO: | GID | Species | Conserved Domains in Polypeptide Amino Acid Coordinates | Conserved Domains in Polynucleotide Base Coordinates | Conserved Domain Sequence | SEQ ID NO: of conserved domain | % ID in conserved domain |
|---|---|---|---|---|---|---|---|
| 106 | G3670 | Lotus corniculatus var. japonicus | HB: 207-270 | HB: 619-810 | KKRYRTKFTPEQKEKML AFAEELGWRIQKHQEAA VEQFCAETCVRRNVLKV WMHNNKNTLGKKP | 1351 | 57% |
| 110 | G3674 | Oryza sativa (indica cultivar-group) | ZF: 61-114 | ZF: 274-435 | ARYRECLKNHAVGIGGH AVDGCGEFMASGEEGSI DALRCAACGCHRNFHRK ESE | 1352 | 72% |
| 110 | G3674 | Oryza sativa (indica cultivar-group) | HB: 226-289 | HB: 769-960 | KKRFRTKFTQEQKDKML AFAERLGWRIQKHDEAA VQQFCEEVCVKRHVLKV WMHNNKHTLGKKA | 1353 | 59% |
| 102 | G3663 | Lotus corniculatus var. japonicus | ZF: 88-141 | ZF: 262-423 | IRYRECERNHAARLGSHV TDGCGEFMPNGEQGTPE SLICAACECHRNFHRKEA Q | 1354 | 70% |
| 102 | G3663 | Lotus corniculatus var. japonicus | HB: 219-282 | HB: 655-846 | KKRFRTKFTQQQKDRM MEFAEKLGWKIQKDEE EVKQFCSHVGVKRQAFK VWMHNSKQAMKKKQ | 1355 | 64% |
| 108 | G3671 | Oryza sativa (japonica cultivar-group) | ZF: 40-93 | ZF: 233-394 | GRYRECLKNHAVGIGGH AVDGCGEFMAAGEEGTI DALRCAACNCHRNFHRK ESE | 1356 | 70% |
| 108 | G3671 | Oryza sativa (japonica cultivar-group) | HB: 200-263 | HB: 713-904 | KKRFRTKFTQEQKDKML AFAERVGWRIQKHDEAA VQQFCDEVGVKRHVLKV WMHNNKHTLGKKL | 1357 | 59% |
| 60 | G2997 | Arabidopsis thaliana | ZF: 47-100 | ZF: 263-424 | IRYRECLKNHAVNIGGHA VDGCCEFMPSGEDGTLD ALKCAACGCHRNFHRKE TE | 1358 | 68% |
| 60 | G2997 | Arabidopsis thaliana | HB: 157-220 | HB: 593-784 | TKRFRTKFTAEQKEKML AFAERLGWRIQKHDDVA VEQFCAETGVRRQVLKI WMHNNKNSLGKKP | 1359 | 59% |
| 116 | G3683 | Oryza sativa (japonica cultivar-group) | ZF: 72-125 | ZF: 214-375 | ARYRECLKNHAAAIGGS ATDGCGEFMPGGEEGSL DALRCSACGCHRNFHRK ELD | 1360 | 68% |
| 116 | G3683 | Oryza sativa (japonica cultivar-group) | HB: 193-256 | HB: 577-768 | RKRFRTKFTAEQKARML GFAEEVGWRLQKLEDAV VQRFCQEVGVKRRVLKV WMHNNKHTLARRH | 1361 | 59% |
| 112 | G3675 | Brassica napus | ZF: 49-102 | ZF: 201-362 | VRYRECLKNHAVNIGGH AVDGCCEFMPSGEDGSL DALKCAACGCHRNFHRK ETE | 1362 | 66% |
| 112 | G3675 | Brassica napus | HB: 162-225 | HB: 540-731 | AKRFRTKFTAEQKDKML AFAERLGWRIQKHDDAA VEQFCAETGVRRQVLKI WMHNNKNSLGRKP | 1363 | 56% |
| 122 | G3690 | Oryza sativa (japonica cultivar-group) | ZF: 161-213 | ZF: 481-639 | WRYRECLKNHAARMGA HVLDGCGEFMSSPGDGA AALACAACGCHRSFHRR EPA | 1364 | 66% |

TABLE 1-continued

Gene families and binding domains for exemplary sequences conferring drought tolerance, including paralogs and orthologs

| SEQ ID NO: | GID | Species | Conserved Domains in Polypeptide Amino Acid Coordinates | Conserved Domains in Polynucleotide Base Coordinates | Conserved Domain Sequence | SEQ ID NO: of conserved domain | % ID in conserved domain |
|---|---|---|---|---|---|---|---|
| 122 | G3690 | *Oryza sativa* (*japonica* cultivar-group) | HB: 318-381 | HB: 952-1143 | KKRFRTKFTAEQKERMR EFAHRVGWRIHKPDAAA VDAFCAQVGVSRRVLKV WMHNNKHLAKTPP | 1365 | 56% |
| 104 | G3668 | *Flaveria bidentis* | ZF: 42-95 | ZF: 410-571 | YRYKECLKNHAVGIGGQ AVDGCGEFMAAGDEGTL DALKCAACNCHRNFHRK EVE | 1366 | 64% |
| 104 | G3668 | *Flaveria bidentis* | HB: 174-237 | HB: 806-997 | KKRFRTKFTQDQKDRML AFSEALGWRIQKHDEAA VQQFCNETGVKRHVLKV WMHNNKHTIGKKP | 1367 | 54% |
| 58 | G2996 | *Arabidopsis thaliana* | ZF: 73-126 | ZF: 241-402 | FRFRECLKNQAVNIGGH AVDGCGEFMPAGIEGTID ALKCAACGCHRNFHRKE LP | 1368 | 64% |
| 58 | G2996 | *Arabidopsis thaliana* | HB: 191-254 | HB: 595-786 | RKRHRTKFTAEQKERML ALAERIGWRIQRQDDEVI QRFCQETGVPRQVLKVW LHNNKHTLGKSP | 1369 | 53% |
| 54 | G2994 | *Arabidopsis thaliana* | ZF: 88-141 | ZF: 329-490 | IKYKECLKNHAAAMGGN ATDGCGEFMPSGEDGSIE ALTCSACNCHRNFHRKE VE | 1370 | 62% |
| 54 | G2994 | *Arabidopsis thaliana* | HB: 218-281 | HB: 719-910 | KKRFRTKFTPEQKEKMLS FAEKVGWKIQRQEDCVV QRFCEEIGVKRRVLKVW MHNNKIHFSKKN | 1371 | 65% |
| 120 | G3686 | *Oryza sativa* (*indica* cultivar-group) | ZF: 38-88 | ZF: 112-264 | CRYHECLRNHAAASGGH VVDGCGEFMPASTEEPL ACAACGCHRSFHRRDPS | 1372 | 62% |
| 120 | G3686 | *Oryza sativa* (*indica* cultivar-group) | HB: 159-222 | HB: 475-666 | RRRSRTTFTREQKEQML APAERVGWRIQRQEEAT VEHFCAQVGVRRQALKV WMHNNKHSFKQKQ | 1373 | 50% |
| 52 | G2993 | *Arabidopsis thaliana* | ZF: 85-138 | ZF: 442-603 | IKYKECLKNHAATMGGN AIDGCGEFMPSGEEGSIE ALTCSVCNCHRNFHRRE TE | 1374 | 61% |
| 52 | G2993 | *Arabidopsis thaliana* | HB: 222-285 | HB: 853-1044 | KKRFRTKFTQEQKEKMIS FAERVGWKIQRQEESVV QQLCQEIGIRRRVLKVW MHNNKQNLSKKS | 1375 | 57% |
| 48 | G2991 | *Arabidopsis thaliana* | ZF: 54-109 | ZF: 218-385 | ATYKECLKNHAAGIGGH ALDGCGEFMPSPSFNSND PASLTCAACGCHRNFHR REED | 1376 | 60% |
| 48 | G2991 | *Arabidopsis thaliana* | HB: 179-242 | HB: 593-784 | RKRFRTKFSQYQKEKMF EFSERVGWRMPKADDVV VKEFCREIGVDKSVFKV WMHNNKISGRSGA | 1377 | 59% |
| 114 | G3680 | *Zea mays* | ZF: 34-89 | ZF: 223-390 | PLYRECLKNHAASLGGH AVDGCGEFMPSPGANPA DPTSLKCAACGCHRNFH RRTLE | 1378 | 60% |

TABLE 1-continued

Gene families and binding domains for exemplary sequences conferring drought tolerance, including paralogs and orthologs

| SEQ ID NO: | GID | Species | Conserved Domains in Polypeptide Amino Acid Coordinates | Conserved Domains in Polynucleotide Base Coordinates | Conserved Domain Sequence | SEQ ID NO: of conserved domain | % ID in conserved domain |
|---|---|---|---|---|---|---|---|
| 114 | G3680 | *Zea mays* | HB: 222-285 | HB: 787-978 | RKRFRTKFTAEQKQRMQ ELSERLGWRLQKRDEAIV DEWCRDIGVGKGVFKV WMHNNKHNFLGGH | 1379 | 50% |
| 118 | G3685 | *Oryza sativa* (japonica cultivar-group) | ZF: 43-95 | ZF: 216-374 | VRYHECERNHAAAMGG HVVDGCREFMPMPGDA ADALKCAACGCHRSFHR KDDG | 1380 | 59% |
| 118 | G3685 | *Oryza sativa* (japonica cultivar-group) | HB: 172-235 | HB: 603-794 | RKRFRTKFTPEQKEQML AFAERVGWRMQKQDEA LVEQFCAQVGVRRQVFK VWMHNNKSSIGSSS | 1381 | 56% |
| 44 | G2989 | *Arabidopsis thaliana* | ZF: 50-105 | ZF: 208-375 | VTYKECLKNHAAAIGGH ALDGCGEFMPSPSSTPSD PTSLKCAACGCHRNFHR RETD | 1382 | 58% |
| 44 | G2989 | *Arabidopsis thaliana* | HB: 192-255 | HB: 634-825 | RKRFRTKFSSNQKEKMH EFADRIGWKIQKRDEDEV RDFCREIGVDKGVLKVW MHNNKNSFKFSG | 1383 | 59% |
| 46 | G2990 | *Arabidopsis thaliana* | ZF: 54-109 | ZF: 206-373 | FTYKECLKNHAAALGGH ALDGCGEFMPSPSSISSDP TSLKCAACGCHRNFHRR DPD | 1384 | 57% |
| 46 | G2990 | *Arabidopsis thaliana* | HB: 200-263 | HB: 644-835 | RKRFRTKFSQFQKEKMH EFAERVGWKMQKRDED DVRDFCRQIGVDKSVLK VWMHNNKNTFNRRD | 1385 | 57% |
| 66 | G3001 | *Arabidopsis thaliana* | ZF: 62-113 | ZF: 222-377 | PHYYECRKNHAADIGTT AYDGCGEFVSSTGEEDSL NCAACGCHRNFHREELI | 1386 | 57% |
| 66 | G3001 | *Arabidopsis thaliana* | HB: 179-242 | HB: 573-764 | VKRLKTKFTAEQTEKMR DYAEKLRWKVRPERQEE VEEFCVEIGVNRKNFRIW MNNHKDKIIIDE | 1387 | 42% |
| 50 | G2992 | *Arabidopsis thaliana* | ZF: 29-84 | ZF: 85-252 | VCYKECLKNHAANLGGH ALDGCGEFMPSPTATSTD PSSLRCAACGCHRNFHRR DPS | 1388 | 55% |
| 50 | G2992 | *Arabidopsis thaliana* | HB: 156-219 | HB: 466-657 | RKRTRTKFTPEQKIKMRA FAEKAGWKINGCDEKSV REFCNEVGIERGVLKVW MHNNKYSLLNGK | 1389 | 48% |
| 128 | G3695 | *Oryza sativa* (japonica cultivar-group) | ZF: 22-71 | ZF: 64-213 | GKYKECMRNHAAAMGG QAFDGCGEYMPASPDSL KCAACGCHRSFHRRAAA | 1390 | 51% |
| 128 | G3695 | *Oryza sativa* (japonica cultivar-group) | HB: 164-227 | HB: 490-681 | RKRFRTKFTPEQKERMRE FAEKQGWRINRNDDGAL DRFCVEIGVKRHVLKVW MHNHKNQLASSP | 1391 | 57% |
| 56 | G2995 | *Arabidopsis thaliana* | ZF: 3-58 | ZF: 143-310 | VLYNECLKNHAVSLGGH ALDGCGEFTPKSTTILTDP PSLRCDACGCHRNFHRRS PS | 1392 | 50% |

TABLE 1 -continued

Gene families and binding domains for exemplary sequences conferring drought tolerance, including paralogs and orthologs

| SEQ ID NO: | GID | Species | Conserved Domains in Polypeptide Amino Acid Coordinates | Conserved Domains in Polynucleotide Base Coordinates | Conserved Domain Sequence | SEQ ID NO: of conserved domain | % ID in conserved domain |
|---|---|---|---|---|---|---|---|
| 56 | G2995 | Arabidopsis thaliana | HB: 115-178 | HB: 479-670 | KKHKRTKFTAEQKVKMR GFAERAGWKINGWDEK WVREFCSEVGIERKVLK VWIHNNKYFNNGRS | 1393 | 45% |
| 124 | G3692 | Oryza sativa (japonica cultivar-group) | ZF: 10-61 | ZF: 28-183 | EVYRECMRNHAAKLGTY ANDGCCEYTPDDGHPAG LLCAACGCHRNFHRKDF L | 1394 | 48% |
| 124 | G3692 | Oryza sativa (japonica cultivar-group) | HB: 119-188 | HB: 355-564 | RRRTRTKFTEEQKARML RFAERLGWRMPKREPGR APGDDEVARFCREIGVNR QVFKVWMHNHKAGGGG GG | 1395 | 58% |
| 126 | G3694 | Oryza sativa (japonica cultivar-group) | ZF: 1-40 | ZF: 1-120 | MGAHVLDGCGEFMSSPG DGAAALACAACGCHRSF HRREPA | 1396 | 48% |
| 126 | G3694 | Oryza sativa (japonica cultivar-group) | HB: 145-208 | HB: 433-624 | KKRFRTKFTAEQKERMR EFAHRVGWRIHKPDAAA VDAFCAQVGVSRRVLKV WMHNNKLLAKTPP | 1397 | 56% |
| 68 | G3002 | Arabidopsis thaliana | ZF: 5-53 | ZF: 81-227 | CVYRECMRNHAAKLGSY AIDGCREYSQPSTGDLCV ACGCHRSYHRRIDV | 1398 | 42% |
| 68 | G3002 | Arabidopsis thaliana | HB: 106-168 | HB: 384-572 | QRRRKSKFTAEQREAMK DYAAKLGWTLKDKRAL REEIRVFCEGIGVTRYHF KTWVNNNKKFYH | 1399 | 35% |

| | | | | | | | % ID to G3086 |
|---|---|---|---|---|---|---|---|
| 16 | G3086 | Arabidopsis thaliana | HLH/MYC: 307-365 | HLH/MYC: 1059-1235 | KRGCATHPRSIAERVRRT KISERMRKLQDLVPNMD TQTNTADMLDLAVQYIK DLQEQVK | 1400 | 100% |
| 188 | G3767 | Glycine max | HLH/MYC: 146-204 | HLH/MYC: 436-612 | KRGCATHPRSIAERVRRT KISERMRKLQDLVPNMD KQTNTADMLDLAVDYIK DLQKQVQ | 1401 | 93% |
| 190 | G3768 | Glycine max | HLH/MYC: 190-248 | HLH/MYC: 568-744 | KRGCATHPRSIAERVRRT KISERMRKLQDLVPNMD KQTNTADMLDLAVDYIK DLQKQVQ | 1402 | 93% |
| 192 | G3769 | Glycine max | HLH/MYC: 240-298 | HLH/MYC: 718-894 | KRGCATHPRSIAERVRRT KISERMRKLQDLVPNMD KQTNTADMLDLAVEYIK DLQNQVQ | 1403 | 93% |
| 174 | G3744 | Oryza sativa (japonica cultivar-group) | HLH/MYC: 71-129 | HLH/MYC: 211-387 | KRGCATHPRSIAERVRRT RISERIRKLQELVPNMDK QTNTADMLDLAVDYIKD LQKQVK | 1404 | 89% |
| 178 | G3755 | Zea mays | HLH/MYC: 97-155 | HLH/MYC: 289-465 | KRGCATHPRSIAERVRRT KISERIRKLQELVPNMDK QTNTSDMLDLAVDYIKD LQKQVK | 1405 | 89% |

TABLE 1 -continued

Gene families and binding domains for exemplary sequences conferring drought tolerance, including paralogs and orthologs

| SEQ ID NO: | GID | Species | Conserved Domains in Polypeptide Amino Acid Coordinates | Conserved Domains in Polynucleotide Base Coordinates | Conserved Domain Sequence | SEQ ID NO: of conserved domain | % ID in conserved domain |
|---|---|---|---|---|---|---|---|
| 26 | G592 | Arabidopsis thaliana | HLH/MYC: 282-340 | HLH/MYC: 964-1140 | KRGCATHPRSIAERVRRT RISERMRKLQELVPNMD KQTNTSDMLDLAVDYIK DLQRQYK | 1406 | 88% |
| 186 | G3766 | Glycine max | HLH/MYC: 35-93 | HLH/MYC: 103-279 | KRGCATHPRSIAERVRRT RISERMRKLQELVPHMD KQTNTADMLDLAVEYIK DLQKQFK | 1407 | 88% |
| 172 | G3742 | Oryza sativa (japonica cultivar-group) | HLH/MYC: 199-257 | HLH/MYC: 595-771 | KRGCATHPRSIAERVRRT RISERIRKLQELVPNMEK QTNTADMLDLAVDYIKE LQKQVK | 1408 | 86% |
| 198 | G3782 | Pinus taeda | HLH/MYC: 471-530 | HLH/MYC: 1411-1590 | KRGCATHPRSIAERVRRT RISERMRKLQELVPNSDK QTVNIADMLDEAVEYVK SLQKQVQ | 1409 | 80% |
| 176 | G3746 | Oryza sativa (japonica cultivar-group) | HLH/MYC: 312-370 | HLH/MYC: 934-1110 | KRGCATHPRSIAERERRT RISKRLKKLQDLVPNMD KQTNTSDMLDIAVTYIKE LQGQVE | 1410 | 79% |
| 184 | G3765 | Glycine max | HLH/MYC: 147-205 | HLH/MYC: 439-615 | KRGFATHPRSIAERVRRT RISERIRKLQELVPTMDK QTSTAEMLDLALDYIKDL QKQFK | 1411 | 79% |
| 194 | G3771 | Glycine max | HLH/MYC: 84-142 | HLH/MYC: 250-426 | KRGCATHPRSIAERVRRT RISDRIRKLQELVPNMDK QTNTADMLDEAVAYVKF LQKQIE | 1412 | 79% |
| 28 | G1134 | Arabidopsis thaliana | HLH/MYC: 187-245 | HLH/MYC: 619-795 | KRGCATHPRSIAERVRRT RISDRIRKLQELVPNMDK QTNTADMLEEAVEYVKV LQRQIQ | 1413 | 77% |
| 168 | G3740 | Oryza sativa (japonica cultivar-group) | HLH/MYC: 141-199 | HLH/MYC: 421-597 | KRGCATHPRSIAERERRT RISEKLRKLQELVPNMDK QTSTADMLDLAVEHIKG LQSQLQ | 1414 | 77% |
| 180 | G3763 | Glycine max | HLH/MYC: 161-219 | HLH/MYC: 481-657 | KRGFATHPRSIAERERRT RISARIKKLQDLFPKSDK QTSTADMLDLAVEYIKD LQKQVK | 1415 | 77% |
| 182 | G3764 | Glycine max | HLH/MYC: 370-428 | HLH/MYC: 1108-1284 | KRGFATHPRSIAERVRRT RISERIKKLQDLFPKSEKQ TSTADMLDLAVEYIKDL QQKVK | 1416 | 77% |
| 196 | G3772 | Glycine max | HLH/MYC: 211-269 | HLH/MYC: 631-807 | KRGCATHPRSIAERERRT RISGKLKKLQDLVPNMD KQTSYADMLDLAVQHIK GLQTQVQ | 1417 | 77% |
| 40 | G2555 | Arabidopsis thaliana | HLH/MYC: 184-242 | HLH/MYC: 726-902 | KRGCATHPRSIAERVRRT RISDRIRRLQELVPNMDK QTNTADMLEEAVEYVKA LQSQIQ | 1418 | 76% |
| 170 | G3741 | Oryza sativa (japonica cultivar-group) | HLH/MYC: 288-346 | HLH/MYC: 862-1038 | KRGCATHPRSIAERERRT RISEKLRKLQALVPNMD KQTSTSDMLDLAVDHIK GLQSQLQ | 1419 | 76% |

TABLE 1 -continued

Gene families and binding domains for exemplary sequences conferring drought tolerance, including paralogs and orthologs

| SEQ ID NO: | GID | Species | Conserved Domains in Polypeptide Amino Acid Coordinates | Conserved Domains in Polynucleotide Base Coordinates | Conserved Domain Sequence | SEQ ID NO: of conserved domain | % ID in conserved domain |
|---|---|---|---|---|---|---|---|
| 38 | G2149 | Arabidopsis thaliana | HLH/MYC: 286-344 | HLH/MYC: 927-1103 | KRGCATHPRSIAERERRT RISGKLKKLQDLVPNMD KQTSYSDMLDLAVQHIK GLQHQLQ | 1420 | 74% |
| 42 | G2766 | Arabidopsis thaliana | HLH/MYC: 234-292 | HLH/MYC: 778-954 | KRGFATHPRSIAERERRT RISGKLKKLQELVPNMD KQTSYADMLDLAVEHIK GLQHQVEI | 1421 | 72% | the MYB-Related Family, Including the G682 Subclade

MYB transcription factors are found in both plants and animals. The MYB-related class of transcription factors is a heterogeneous group of 54 proteins that are connected to one another through their evolutionary relationship with proteins containing a MYB DNA binding motif. MYB proteins share a signature DNA-binding domain of approximately 50 amino acids that contains a series of highly conserved residues with a characteristic spacing. Critical in the formation of the tertiary structure of the conserved MYB motif is a series of consistently spaced tryptophan residues. Animal MYBs contain three repeats of the MYB domain: R1, R2, and R3. Plant MYBs usually contain two imperfect MYB repeats near their amino termini: R2 and R3 (136 in *Arabidopsis* genome) although there is a small subgroup of three repeat (R1R2R3) MYBs similar to those found in animals, numbering approximately five in the *Arabidopsis* genome. Each MYB repeat has the potential to form three alpha-helical segments, resembling a helix-turn-helix structure. Repeats R2 and R3 are responsible for the sequence-specific DNA-binding of MYB proteins (Howe et al. (1990) *EMBO J.* 9: 161-169). Once bound, MYB proteins function to facilitate transcriptional activation or repression, and this sometimes involves interaction with a protein partner (Goff et al. (1992) *Genes Dev.* 6: 864-875).

G682 is a member of the MYB-related family of transcription factors. There appear to be 48 Myb-related genes in *Arabidopsis*. The Myb-related genes are similar to the classic plant Myb(R1)R2R3 genes in that they share a signature DNA-binding domain sequence of approximately 45 amino acids that contains a series of highly conserved residues with a characteristic spacing. Unlike the Myb(R1)R2R3 genes, which generally contain two or three Myb repeats, the majority of the Myb-related genes contain only one complete Myb domain. There are several Myb-related genes that have two repeat domains, however the spacing between the domains is greater than that seen in the Myb (R1)R2R3 family and the sequence of each domain bears a much higher similarity to the genes in the Myb-related family than the Myb(R1)R2R3 family. The G682 coding sequence corresponds to At4G01060, annotated by the *Arabidopsis* Genome initiative. This gene is one of a five-member clade of related proteins that range in size from 75 to 112 amino acids. These proteins contain a single MYB repeat. Two well characterized transcription factors, CIRCADIAN CLOCK ASSOCIATED1 (CCA1/G214) and LATE ELONGATED HYPOCOTYL (LHY/G680) are among the other MYB-related proteins that contain single MYB repeats (Wang et al. (1997) *Plant Cell.* 9: 491507; Schaffer et al. (1998) *Cell* 93: 1219-1229).

All members of the G682 subclade were found to have epidermal cell type alterations when overexpressed in *Arabidopsis*; for instance, so far all characterized members of the clade show increased numbers of root hairs compared to wild type plants, as well as a reduction in trichome number. In addition, overexpression lines for all members of the clade showed a reduction in anthocyanin accumulation in response to stress, and enhanced tolerance to abiotic stress. In the case of 35S::G682 transgenic lines, an enhanced tolerance to high heat conditions was observed. Heat can cause osmotic stress; it is therefore consistent that these transgenic lines were also more tolerant to drought stress in a soil-based assay. Table 2 summarizes the data for a variety of abiotic stresses with G682 and its clade members. Another common feature of all of the members of this clade that have thus far been examined (constituting a majority of the sequences appearing in the box in FIG. 21) is that they enhance a plant's performance in nitrogen limiting conditions, as evidenced by altered C/N sensing and/or germination assays in low nitrogen environments.

The difference in the phenotypic responses of the overexpression lines suggests that each of these genes could have slightly different but related functions in the plant. One of the G682 subclade members, G1816 (TRIPTYCHON, TRY), is only partially redundant with CAPRICE (CPC; Schellmann et al. (2002) *EMBO J.* 21: 5036-5046). No genetic data has been reported for G682, G226, or G2718 in the literature.

Epidermal cell fate specification in the root, the hypocotyl, the leaf and the seed coat involves similar set of genes that presumably function in mechanistically similar ways in the various epidermal cell types. The signals that specify epidermal cell fate in different parts of the plant must therefore feed into a common signal transduction cascade. Such a cascade, consisting of members of the same gene family (that have evolved from gene duplication of common ancestors) must have adopted new and different functions to variable degrees, in different regions of the plant.

Table 2 compiles a list of genes that have been implicated in root hair and trichome cell specification through genetic and biochemical characterization in *Arabidopsis* from the public literature as well as from our own discoveries.

TABLE 2

Genes implicated in root hair and trichome cell specification

| Gene Name | GL3 | GL1 | WER | GL2 | TTG1 | CAPRICE (CPC) | TRY (G1816) |
|---|---|---|---|---|---|---|---|
| Gene Family | bHLH/MYC | MYB-(R1)R2R3 | MYB-(R1)R2R3 | HD | n/a | MYB-related | MYB-related |
| Loss-of-Function | None detected | Glabrous | All cell files are hairs | Ectopic hairs, glabrous | All cell files are hairs, glabrous | No root hairs, ectopic trichomes | wild-type roots, ectopic trichomes |
| Gain-of-Function | Ectopic trichomes | Ectopic trichomes | Wild-type | Wild-type | Wild-type | Ectopic root hairs, glabrous | Ectopic root hairs, glabrous |
| Site of Activity | Leaf Epidermis | Leaf Epidermis | Root Epidermis | Leaf epidermis, root epidermis and seed coat | Leaf epidermis, root epidermis and seed coat | Leaf epidermis and root epidermis | Leaf epidermis and root epidermis |
| Reference | Payne et al. (2000) | (Di Cristina et al. 1996) | Lee and Schiefelbein (1999) | Masucci et al., (1994), DiCristina et al. (1996) | Galway et al. (1994) | Wada et al. (1997) | Schellmann et al. (2002) |

References:
Di Cristina et al. (1996) *Plant J.* 10: 393-402
Galway et al (1994) *Dev. Biol.* 166, : 740-754
Lee and Schiefelbein (1999) *Cell* 99: 473-483
Masucci et al. (1994) *Plant Physiol.* 106: 1335-1346
Payne et al. (2000) *Genetics* 156: 1349-1362
Schellmann et al. (2002) *EMBO J.* 21: 5036-5046
Wada et al. (1997) *Science* 277: 1113-1116

In recently proposed genetic models to explain trichome and root hair cell specification, a theoretical model of lateral inhibition first put forth by Wigglesworth (1940) *J. Exp. Biol.* 17: 180-200) was used (Schellmann et al. (2002) supra; Lee and Schiefelbein (2002) *Plant Cell* 14: 611-618). Lateral inhibition is a process whereby a cell that has taken a certain fate prevents its neighbors from taking that same fate. The mechanism of lateral inhibition involves diffusible activators and repressors. The activator complex stimulates its own expression as well as that of the repressor. The repressor then moves across cell boundaries to suppress the activator complex found in neighboring cells. Since it is conceivable that both activator and repressor are capable of diffusion across cell boundaries, in this model it is proposed that the repressor is slightly smaller and therefore diffuses more quickly resulting in the overall suppression of the activator in neighboring cells (Schellmann et al. (2002) supra). In other words, in cells where the proteins are initially being produced, the scales are still tipped in the direction of the activator and in the neighboring cells the scales are tipped in the direction of the repressor.

In leaf epidermal tissue, the default program is the formation of a trichome cell fate through the activity of the homeobox transcription factor, GLABRA2 (GL2). GL2 is known to be induced by the proposed "activator complex" that is composed of GL1, a MYB-related protein, TTG1 a WD-40 repeat containing protein, and GL3, a bHLH transcription factor. The formation of this complex is supported by genetic data as well as by biochemical data. Yeast 2-hybrid data shows that GL3 interacts with both TTG1 and GL1 (Payne et al. (2000) supra). A non-trichome cell fate, on the other hand, is specified in neighboring cells through the combined activity of two repressors, TRY (G1816) and CPC. TRY and CPC are paralogs and most likely function in a very similar manner. However, based on the different phenotypes of try and cpc mutants with respect to trichome initiation, and the additive phenotype of the double mutant, Schellmann et al. (Schellmann et al. (2002) supra) concluded that their function was slightly different, and proposed that CPC and TRY might interact with different proteins in the "activator complex". This might explain the differences in the phenotypes observed in the mutants.

In the lateral inhibition model described above for trichome cell specification, GL1, TTG1 and GL3 function in a regulatory feedback loop, enhancing their own expression. A complex composed of those three proteins, activates GL2 that then functions in promoting trichome cell fate. The GL1/TTG/GL3 complex also serves to activate the repressors CPC and TRY that then results in the prevention of trichome formation in neighboring cells.

Similarly in the root epidermis, but with reverse logic, the "activator complex" promotes a non-hair cell fate. In neighboring cells where the repressor activity accumulates to a greater degree, a hair cell fate is determined. Involvement of CPC in a lateral inhibition model in root hair cell specification was supported by a series of genetic experiments recently described (Lee and Schiefelbein (2002) supra). The proposed "activator" that is important for the specification of a non-root hair cell fate is thought to be composed of WER (MYB-related transcription factor and paralog to GL1), TTG1 and a bHLH transcription factor that has yet to be identified. (The maize bHLH transcription factor, R, was capable of suppressing the ttg1 root hair phenotype suggesting that a similar bHLH is involved in this process). Genetic data supports the model that proposes that the activator complex activates the homeodomain transcription factor GL2 (a positive regulator of atrichoblast [non-hair] cell fate in the root). The repressor proteins in this model are, again, postulated to be CPC and TRY (G1816). Consistent with this model, Lee and Schiefelbein (Lee and Schiefelbein (2002) supra) have shown that CPC inhibits the expression of WER, GL2 and itself. They have also shown that WER activates GL2 and CPC.

Candidate genes for the bHLH component of the "activator complex" in root hair development are G1666 (TT8) and G581. Both genes are similar in sequence to the maize R-gene and we found that both had seed anthocyanin phenotypes when overexpressed. Anthocyanin production is consistent with genes that potentially have maize R-like activity.

The fact that all of the G682 subclade members have slightly different phenotypes suggests that the genes do not have completely overlapping or redundant functions in the plant. The low nitrogen and other abiotic stress tolerance phenotypes in these lines may be related to the increase in root hairs on the root epidermis. Increasing root hair density could provide an increase in absorptive surface area and an increase in nitrate transporters that are normally found there. Alternatively, ectopic expression of these transcription factors may affect stomate formation as has been reported for wer, ttg1 and gl2 mutations (Hung et al. (1998) *Plant Physiol.* 117: 73-84; Berger et al. (1998) *Dev. Biol.* 194: 226-234; Lee and Schiefelbein (1999) supra). Such alterations in stomate production could alter plant water status. Interestingly, our data also indicated that G1816 (TRY) overexpression lines had a glucose sugar sensing phenotype. Several sugar-sensing mutants have turned out to be allelic to ABA and ethylene mutants. This potentially implicates G1816 in hormone signaling.

Because the G682 subclade members are short proteins that are comprised of almost exclusively a DNA binding motif, it is possible that they function as repressors. Repression could occur at the level of DNA binding through competition with other factors at target promoters. Repression through protein-protein interactions, though, cannot be excluded. An alternative model is that the G682 subclade members function by activating a second pathway that has not yet been identified.

The residues in the boxes in FIG. 20B may be used to identify G682 subclade members. Of the sequences examined to date, a valine (corresponding to position 50 of G682 and a glutamate residue (at a position corresponding to position 70 of G682) were found that are present in members of the G682 subclade (these residues may be found in the boxes and below the arrows in FIG. 20B) but not outside of the subclade. All members of the clade examined thus far have the subsequence:

E-$(X)_9$-L-V-G-$(X)_2$-W-$(X)_2$-I-A-G-R-$(X)_2$-G-R-$(X)_5$-E-$(X)_2$-W (SEQ ID NO: 1422), where X is any amino acid.

Table 3 shows the G682 subclade polypeptides identified by polypeptide SEQ ID NO and Identifier (e.g., Gene ID (GID) No., accession number or other name), and includes the species from which each sequence was derived, the coordinates of the MYB-related domains in polypeptide amino acid coordinates and polynucleotide base coordinates, the respective domain sequences, and the extent of identity in percentage terms to the MYB-related domain of G682. It is of interest to note that a number of non-*Arabidopsis* monocot and dicot sequences are more similar to G682 than a number of the *Arabidopsis* paralogs that are functionally similar to G682.

TABLE 3

Gene families and binding domains for exemplary sequences altering C/N sensing, including paralogs and orthologs

| SEQ ID NO: | Identifier | Species | Polypeptide Amino Acid Coordinates of the MYB-related Domain | Polynucleotide Base Coordinates of the MYB-related Domain | MYB-related Domain Sequence | SEQ ID NO: of Myb-related Domain Sequence | % ID to MYB-related Domain of G682 |
|---|---|---|---|---|---|---|---|
| 234 | G682 | Arabidopsis thaliana | 33-77 | 99-233 | VNMSQEEDLVSRMH KLVGDRWELIAGRIPG RTAGEIERFWVMKN | 1423 | 100% |
| 324 | G2718 | Arabidopsis thaliana | 32-76 | 94-228 | IAMAQEEEDLICRMYK LVGERWDLIAGRIPGRT AEEIERFWVMKN | 1424 | 80% |
| 328 | G3393 | Oryza sativa (japonica cultivar-group) | 31-75 | 172-306 | VHFTEEEEDLVFRMHR LVGNRWELIAGRIPGRT AKEVEMFWAVKH | 1425 | 71% |
| 326 | G3392 | Oryza sativa (japonica cultivar-group) | 32-76 | 143-277 | VHFTEEEEDIVFRMHRL VGNRWELIAGRIPGRT AEEVEKFWAIKH | 1426 | 68% |
| 360 | G3431 | Zea mays | 31-75 | 94-228 | VDFTEAEEDLVSRMHR LVGNRWEIIAGRIPGRT AEEVEMFWSKKY | 1427 | 68% |
| 370 | G3444 | Zea mays | 31-75 | 104-238 | VDFTEAEEDLVSRMHR LVGNRWEIIAGRIPGRT AEEVEMFWSKKY | 1428 | 68% |
| 382 | G3450 | Glycine max | 20-64 | 83-217 | IHMSEQEEDLIRRMYK LVGDKWNLIAGRIPGR KAEEIERFWIMRH | 1429 | 68% |
| 312 | G1816 | Arabidopsis thaliana | 30-74 | 88-222 | INMTEQEEDLIFRMYRL VGDRWDLIAGRVPGRQ PEEIERYWIMRN | 1430 | 64% |

TABLE 3 -continued

Gene families and binding domains for exemplary sequences altering C/N sensing, including paralogs and orthologs

| SEQ ID NO: | Identifier | Species | Polypeptide Amino Acid Coordinates of the MYB-related Domain | Polynucleotide Base Coordinates of the MYB-related Domain | MYB-related Domain Sequence | SEQ ID NO: of Myb-related Domain Sequence | % ID to MYB-related Domain of G682 |
|---|---|---|---|---|---|---|---|
| 286 | G226 | Arabidopsis thaliana | 38-82 | 121-255 | ISMTEQEEDLISRMYRL VGNRWDLIAGRVVGR KANEIERYWIMRN | 1431 | 62% |
| 380 | G3449 | Glycine max | 26-70 | 95-229 | VEFSEDEETLIIRMYKL VGERWSLIAGRIPGRTA EEIEKYWTSRF | 1432 | 62% |
| 378 | G3448 | Glycine max | 26-70 | 96-230 | VEFSEDEETLIIRMYKL VGERWSIIAGRIPGRTA EEIEKYWTSRF | 1433 | 60% |
| 372 | G3445 | Glycine max | 25-69 | 89-223 | VEFSEAEEILIAMVYNL VGERWSLIAGRIPGRTA EEIEKYWTSRF | 1434 | 55% |
| 374 | G3446 | Glycine max | 26-70 | 92-226 | VEFSEAEEILIAMVYNL VGERWSLIAGRIPGRTA EEIEKYWTSRF | 1435 | 55% |
| 376 | G3447 | Glycine max | 26-70 | 85-219 | VEFSEAEEILIAMVYNL VGERWSLIAGRIPGRTA EEIEKYWTSRF | 1436 | 55% |

Table 4 shows polypeptides of the invention identified by SEQ ID NO; Identifier (for example, Gene ID (GID) No); the transcription factor family to which the polypeptide belongs, and conserved domains of the polypeptide. The first column shows the polypeptide SEQ ID NO; the third column shows the transcription factor family to which the polynucleotide belongs; and the fourth column shows the amino acid residue positions of the conserved domain in amino acid (AA) coordinates.

TABLE 4

Gene families and conserved domains

| Polypeptide SEQ ID NO: | Identifier | Family | Conserved Domains in Amino Acid Coordinates |
|---|---|---|---|
| 224 | G175 | WRKY | 178-234, 372-428 |
| 226 | G303 | HLH/MYC | 92-161 |
| 228 | G354 | Z-C2H2 | 42-62, 88-109 |
| 230 | G489 | CAAT | 57-156 |
| 232 | G634 | TH | 62-147, 189-245 |
| 234 | G682 | MYB-related | 27-63 |
| 236 | G916 | WRKY | 293-349 |
| 238 | G975 | AP2 | 4-71 |
| 240 | G1069 | AT-hook | 67-75, 76-218 |
| 242 | G1452 | NAC | 55-196 |
| 244 | G1820 | CAAT | 70-133 |
| 246 | G2701 | MYB-related | 33-81, 129-183 |
| 248 | G2789 | AT-hook | 59-67, 68-208 |
| 250 | G2839 | Z-C2H2 | 34-60, 85-113 |
| 252 | G2854 | ACBF-like | 110-250 |
| 254 | G3083 | bZIP-ZW2 | 75-105, 188-215 |
| 256 | G184 | WRKY | 295-352 |
| 258 | G186 | WRKY | 312-369 |
| 260 | G353 | Z-C2H2 | 41-61, 84-104 |
| 262 | G512 | NAC | 24-166 |
| 264 | G596 | AT-hook | 89-96 |
| 266 | G714 | CAAT | 58-148 |
| 268 | G877 | WRKY | 272-328, 487-603 |
| 270 | G1357 | NAC | 17-158 |
| 272 | G1387 | AP2 | 4-71 |
| 274 | G1634 | MYB-related | 129-180 |
| 276 | G1889 | Z-C2H2 | 80-100 |
| 278 | G1940 | ACBF-like | 156-228 |
| 280 | G1974 | Z-C2H2 | 32-60, 72-116 |
| 282 | G2153 | AT-hook | 75-94, 162-206 |
| 284 | G2583 | AP2 | 4-71 |
| 286 | G226 | MYB-related | 28-78 |
| 288 | G481 | CAAT | 20-109 |
| 290 | G482 | CAAT | 25-116 |
| 292 | G485 | CAAT | 21-116 |
| 294 | G486 | CAAT | 5-66 |
| 296 | G1067 | AT-hook | 86-92, 94-247 |
| 298 | G1070 | AT-hook | 98-120 |
| 300 | G1073 | AT-hook | 34-42, 43-187 |
| 302 | G1075 | AT-hook | 78-85 |
| 304 | G1076 | AT-hook | 82-89 |
| 306 | G1248 | CAAT | 46-155 |
| 308 | G1364 | CAAT | 29-118 |
| 310 | G1781 | CAAT | 35-130 |
| 312 | G1816 | MYB-related | 31-81 |
| 314 | G1945 | AT-hook | 49-71 |
| 316 | G2155 | AT-hook | 18-38 |
| 318 | G2156 | AT-hook | 72-78, 80-232 |
| 320 | G2345 | CAAT | 26-152 |
| 322 | G2657 | AT-hook | 116-129 |
| 324 | G2718 | MYB-related | 21-76 |
| 326 | G3392 | MYB-related | 21-72 |
| 328 | G3393 | MYB-related | 20-71 |
| 330 | G3394 | CAAT | 37-126 |
| 332 | G3395 | CAAT | 19-108 |
| 334 | G3396 | CAAT | 21-110 |
| 338 | G3397 | CAAT | 23-112 |
| 338 | G3398 | CAAT | 21-110 |

TABLE 4-continued

Gene families and conserved domains

| Polypeptide SEQ ID NO: | Identifier | Family | Conserved Domains in Amino Acid Coordinates |
|---|---|---|---|
| 340 | G3399 | AT-hook | 99-107, 108-253 |
| 342 | G3400 | AT-hook | 83-89, 91-237 |
| 344 | G3401 | AT-hook | 35-41, 43-186 |
| 346 | G3403 | AT-hook | 58-64, 66-207 |
| 348 | G3404 | AT-hook | 111-117, 119-263 |
| 350 | G3405 | AT-hook | 97-103, 105-248 |
| 352 | G3406 | AT-hook | 82-88, 90-232 |
| 354 | G3407 | AT-hook | 63-71, 72-220 |
| 356 | G3408 | AT-hook | 83-89, 91-247 |
| 358 | G3429 | CAAT | 35-124 |
| 360 | G3431 | MYB-related | 20-71 |
| 362 | G3434 | CAAT | 18-107 |
| 364 | G3435 | CAAT | 22-111 |
| 366 | G3436 | CAAT | 20-109 |
| 368 | G3437 | CAAT | 54-143 |
| 370 | G3444 | MYB-related | 20-71 |
| 372 | G3445 | MYB-related | 15-65 |
| 374 | G3446 | MYB-related | 16-66 |
| 376 | G3447 | MYB-related | 16-66 |
| 378 | G3448 | MYB-related | 15-65 |
| 380 | G3449 | MYB-related | 15-65 |
| 382 | G3450 | MYB-related | 9-60 |
| 384 | G3456 | AT-hook | 44-52, 53-195 |
| 386 | G3458 | AT-hook | 56-62, 64-207 |
| 388 | G3459 | AT-hook | 77-85, 86-228 |
| 390 | G3460 | AT-hook | 74-82, 83-225 |
| 392 | G3462 | AT-hook | 82-88, 90-237 |
| 394 | G3470 | CAAT | 27-116 |
| 396 | G3471 | CAAT | 26-115 |
| 398 | G3472 | CAAT | 25-114 |
| 400 | G3473 | CAAT | 23-113 |
| 402 | G3474 | CAAT | 25-114 |
| 404 | G3475 | CAAT | 23-112 |
| 406 | G3476 | CAAT | 26-115 |
| 408 | G3477 | CAAT | 27-116 |
| 410 | G3478 | CAAT | 23-112 |
| 412 | G3556 | AT-hook | 45-51, 53-196 |
| 414 | G3835 | CAAT | 4-92 |
| 416 | G3836 | CAAT | 34-122 |
| 418 | G3837 | CAAT | 35-123 |
| 420 | G24 | AP2 | 25-92 |
| 422 | G154 | MADS | 2-57 |
| 424 | G384 | HB | 14-77 |
| 294 | G486 | CAAT | 5-66 |
| 426 | G545 | Z-C2H2 | 82-102, 136-154 |
| 428 | G760 | NAC | 12-156 |
| 430 | G773 | NAC | 17-159 |
| 432 | G937 | GARP | 197-246 |
| 434 | G971 | AP2 | 120-186 |
| 436 | G988 | SCR | 146-217, 278-366, 370-444 |
| 438 | G989 | SCR | 121-186, 238-327, 326-399 |
| 240 | G1069 | AT-hook | 67-74 |
| 440 | G1090 | AP2 | 17-84 |
| 442 | G1322 | MYB-(R1)R2R3 | 26-130 |
| 444 | G1587 | HB | 61-121 |
| 446 | G1666 | HLH/MYC | 353-420 |
| 448 | G1700 | RING/C3H2C3 | 93-134 |
| 450 | G1818 | CAAT | 36-113 |
| 452 | G1868 | GRF-like | 164-270 |
| 454 | G1888 | Z-CO-like | 5-50 |
| 456 | G2117 | bZIP | 46-106 |
| 458 | G2131 | AP2 | 50-121, 146-217 |
| 460 | G2520 | HLH/MYC | 135-206 |
| 462 | G2522 | AT-hook | At-hooks: 101-109 & 134-142 2nd domain: 143-291 |
| 248 | G2789 | AT-hook | 53-73, 121-165 |
| 464 | G8 | AP2 | 151-217, 243-293 |
| 466 | G27 | AP2 | 37-104 |
| 468 | G156 | MADS | 2-57 |
| 470 | G161 | MADS | 6-62 |
| 472 | G168 | MADS | 1-57 |
| 474 | G183 | WRKY | 307-368 |
| 476 | G189 | WRKY | 240-297 |
| 478 | G200 | MYB-(R1)R2R3 | 12-116 |
| 480 | G234 | MYB-(R1)R2R3 | 14-115 |
| 482 | G237 | MYB-(R1)R2R3 | 11-113 |
| 484 | G275 | AKR | 308-813 |
| 486 | G326 | Z-CO-like | 11-94, 354-400 |
| 488 | G347 | Z-LSDlike | 9-39, 50-70, 80-127 |
| 490 | G427 | HB | 307-370 |
| 492 | G505 | NAC | 20-170 |
| 494 | G590 | HLH/MYC | 202-254 |
| 496 | G602 | DBP | 110-162 |
| 498 | G618 | TEO | 32-89 |
| 500 | G635 | TH | 239-323 |
| 502 | G643 | TH | 47-85 |
| 504 | G653 | Z-LIM | 10-61, 109-160 |
| 506 | G657 | MYB-(R1)R2R3 | 35-187 |
| 508 | G837 | AKR | 250-754 |
| 510 | G866 | WRKY | 43-300 |
| 512 | G872 | AP2 | 18-84 |
| 514 | G904 | RING/C3H2C3 | 117-158 |
| 516 | G912 | AP2 | 51-118 |
| 518 | G932 | MYB-(R1)R2R3 | 14-118 |
| 520 | G958 | NAC | 7-156 |
| 522 | G964 | HB | 126-186 |
| 238 | G975 | AP2 | 4-71 |
| 524 | G979 | AP2 | 63-139, 165-233 |
| 526 | G1049 | bZIP | 77-132 |
| 528 | G1246 | MYB-(R1)R2R3 | 27-139 |
| 530 | G1255 | Z-CO-like | 18-56 |
| 532 | G1266 | AP2 | 79-147 |
| 534 | G1331 | MYB-(R1)R2R3 | 8-109 |
| 536 | G1332 | MYB-(R1)R2R3 | 13-116 |
| 538 | G1494 | HLH/MYC | 261-311 |
| 540 | G1535 | HB | 109-169 |
| 542 | G1649 | HLH/MYC | 225-295 |
| 544 | G1750 | AP2 | 115-182 |
| 546 | G1773 | RING/C3HC4 | 139-184 |
| 548 | G1835 | GATA/Zn | 224-296 |
| 550 | G1930 | AP2 | 59-124, 179-273 |
| 10 | G2053 | NAC | 6-152 |
| 552 | G2057 | TEO | 46-103 |
| 12 | G2133 | AP2 | 10-77 |
| 554 | G2144 | HLH/MYC | 203-283 |
| 556 | G2145 | HLH/MYC | 166-243 |
| 558 | G2295 | MADS | 1-57 |
| 560 | G2512 | AP2 | 79-147 |
| 562 | G2531 | NAC | 52-212 |
| 564 | G2535 | NAC | 11-114 |
| 566 | G2590 | MADS | 2-57 |
| 568 | G2719 | MYB-(R1)R2R3 | 56-154 |
| 570 | G9 | AP2 | 62-127, 184-277 |
| 572 | G12 | AP2 | 27-94 |
| 574 | G40 | AP2 | 45-112 |
| 576 | G41 | AP2 | 39-106 |
| 578 | G42 | AP2 | 48-115 |
| 2 | G47 | AP2 | 10-75 |
| 580 | G170 | MADS | 2-57 |
| 582 | G216 | MYB-(R1)R2R3 | 49-151 |
| 584 | G221 | MYB-(R1)R2R3 | 21-125 |
| 586 | G232 | MYB-(R1)R2R3 | 14-115 |
| 588 | G249 | MYB-(R1)R2R3 | 19-116 |
| 590 | G256 | MYB-(R1)R2R3 | 13-115 |
| 592 | G350 | Z-C2H2 | 91-113, 150-170 |
| 594 | G351 | Z-C2H2 | 77-97, 118-140 |
| 596 | G385 | HB | 60-123 |
| 598 | G389 | HB | 84-147 |
| 600 | G398 | HB | 128-191 |
| 602 | G399 | HB | 126-186 |
| 604 | G425 | HB | 305-365 |
| 606 | G426 | HB | 346-406 |
| 608 | G440 | AP2 | 122-189 |
| 610 | G441 | AP2 | 40-107 |
| 20 | G515 | NAC | 6-149 |
| 22 | G516 | NAC | 6-141 |
| 24 | G517 | NAC | 6-153 |
| 612 | G518 | NAC | QEEDLIR614 |
| 614 | G572 | bZIP | 120-186 |

TABLE 4-continued

Gene families and conserved domains

| Polypeptide SEQ ID NO: | Identifier | Family | Conserved Domains in Amino Acid Coordinates |
|---|---|---|---|
| 264 | G596 | AT-hook | 89-96 |
| 616 | G654 | Z-LIM | 10-61, 108-159 |
| 618 | G666 | MYB-(R1)R2R3 | 14-118 |
| 620 | G668 | MYB-(R1)R2R3 | 13-113 |
| 622 | G759 | NAC | 17-159 |
| 624 | G789 | HLH/MYC | 253-313 |
| 626 | G829 | AKR | 250-754 |
| 628 | G864 | AP2 | 119-186 |
| 630 | G867 | AP2 | 59-124, 184-276 |
| 632 | G883 | WRKY | 245-302 |
| 634 | G914 | AP2 | 106-162, 198-238 |
| 636 | G957 | NAC | 12-182 |
| 638 | G961 | NAC | 12-180 |
| 640 | G993 | AP2 | 69-134, 191-290 |
| 642 | G1011 | MADS | 2-57 |
| 644 | G1065 | DBP | 101-210 |
| 646 | G1071 | AT-hook | 98-111, 132-138, 140-286 |
| 648 | G1277 | AP2 | 18-85 |
| 650 | G1309 | MYB-(R1)R2R3 | 9-114 |
| 652 | G1337 | Z-CO-like | 9-75 |
| 654 | G1379 | AP2 | 18-85 |
| 656 | G1386 | AP2 | 42-109 |
| 272 | G1387 | AP2 | 4-71 |
| 658 | G1412 | NAC | 13-162 |
| 660 | G1439 | GRF-like | 133-239 |
| 662 | G1482 | Z-CO-like | 5-63 |
| 664 | G1484 | Z-CO-like | 16-39 |
| 666 | G1588 | HB | 66-124 |
| 668 | G1752 | AP2 | 83-151 |
| 670 | G1836 | CAAT | 30-164 |
| 672 | G1942 | HLH/MYC | 178-270 |
| 674 | G2065 | MADS | 1-57 |
| 676 | G2106 | AP2 | 56-139, 165-233 |
| 678 | G2107 | AP2 | 27-94 |
| 680 | G2148 | HLH/MYC | 130-268 |
| 282 | G2153 | AT-hook | 75-94, 162-206 |
| 682 | G2180 | NAC | 7-156 |
| 684 | G2513 | AP248 | 27-94 |
| 686 | G2545 | HB | 215-278 |
| 688 | G2576 | AP2 | 9-75 |
| 284 | G2583 | AP2 | 4-71 |
| 690 | G3041 | NAC | 8-136 |
| 692 | G3362 | AP2 | 41-108 |
| 694 | G3364 | AP2 | 51-114 |
| 696 | G3365 | AP2 | 41-108 |
| 698 | G3366 | AP2 | 53-117 |
| 700 | G3367 | AP2 | 51-114 |
| 702 | G3368 | AP2 | 51-120 |
| 704 | G3369 | AP2 | 107-170 |
| 706 | G3370 | AP2 | 29-99 |
| 708 | G3371 | AP2 | 36-102 |
| 710 | G3372 | AP2 | 30-95 |
| 712 | G3373 | AP2 | 43-109 |
| 714 | G3374 | AP2 | 51-118 |
| 716 | G3375 | AP2 | 49-113 |
| 718 | G3376 | AP2 | 51-115 |
| 720 | G3377 | AP2 | 41-107 |
| 722 | G3378 | AP2 | 83-154 |
| 724 | G3379 | AP2 | 47-119 |
| 726 | G3384 | MYB-(R1)R2R3 | 14-118 |
| 728 | G3385 | MYB-(R1)R2R3 | 14-118 |
| 730 | G3386 | MYB-(R1)R2R3 | 14-118 |
| 732 | G3388 | AP2 | 66-129, 181-274 |
| 734 | G3389 | AP2 | 64-129, 177-266 |
| 736 | G3390 | AP2 | 66-131, 192-294 |
| 738 | G3391 | AP2 | 79-148, 215-300 |
| 344 | G3401 | AT-hook | 35-41, 43-186 |
| 346 | G3403 | AT-hook | 58-64, 66-207 |
| 740 | G3432 | AP2 | 75-140, 212-299 |
| 742 | G3433 | AP2 | 80-151, 210-291 |
| 744 | G3438 | AP2 | 50-116 |
| 746 | G3439 | AP2 | 57-126 |
| 748 | G3440 | AP2 | 49-116 |
| 750 | G3441 | AP2 | 55-120 |
| 752 | G3442 | AP2 | 61-127 |
| 754 | G3451 | AP2 | 80-141, 209-308 |
| 756 | G3452 | AP2 | 51-116, 171-266 |
| 758 | G3453 | AP2 | 57-122, 177-272 |
| 760 | G3454 | AP2 | 74-141, 203-302 |
| 384 | G3456 | AT-hook | 44-50, 52-195 |
| 392 | G3462 | AT-hook | 82-88, 90-237 |
| 762 | G3463 | AP2 | 60-125 |
| 764 | G3464 | AP2 | 50-114 |
| 766 | G3465 | AP2 | 61-125 |
| 768 | G3466 | AP2 | 63-127 |
| 770 | G3467 | AP2 | 60-123 |
| 772 | G3468 | AP2 | 63-128 |
| 774 | G3469 | AP2 | 16-79 |
| 776 | G3497 | AP2 | 51-114 |
| 778 | G3498 | AP2 | 50-114 |
| 780 | G3499 | AP2 | 46-111 |
| 782 | G3500 | MYB-(R1)R2R3 | 14-118 |
| 784 | G3501 | MYB-(R1)R2R3 | 14-118 |
| 786 | G3502 | MYB-(R1)R2R3 | 14-119 |
| 788 | G3537 | MYB-(R1)R2R3 | 14-118 |
| 790 | G3538 | MYB-(R1)R2R3 | 13-117 |
| 792 | G3539 | MYB-(R1)R2R3 | 14-118 |
| 794 | G3540 | MYB-(R1)R2R3 | 14-118 |
| 796 | G3541 | MYB-(R1)R2R3 | 14-118 |
| 412 | G3556 | AT-hook | 45-51, 53-196 |
| 88 | G3643 | AP2 | 13-78 |
| 90 | G3644 | AP2 | 52-122 |
| 92 | G3645 | AP2 | 10-75 |
| 94 | G3646 | AP2 | 10-77 |
| 96 | G3647 | AP2 | 13-78 |
| 98 | G3649 | AP2 | 15-87 |
| 100 | G3651 | AP2 | 60-130 |
| 798 | G3652 | AP2 | 13-78 |
| 800 | G3653 | AP2 | 41-107 |
| 802 | G3654 | AP2 | 9-76 |
| 804 | G3655 | AP2 | 31-96 |
| 806 | G3656 | AP2 | 23-86 |
| 232 | G634 | TH | 62-147, 189-245, |
| 808 | G1048 | bZIP | 138-190 |
| 810 | G1100 | RING/C3H2C3 | 96-137 |
| 658 | G1412 | NAC | 13-162 |
| 812 | G1796 | AP2 | 54-121 |
| 814 | G1995 | Z-C2H2 | 93-113 |
| 816 | G2467 | HS | 28-119 |
| 818 | G2505 | NAC | 9-137 |
| 820 | G2550 | HB | 345-408 |
| 822 | G2640 | SRS | 146-189 |
| 824 | G2686 | WRKY | 122-173 |
| 248 | G2789 | AT-hook | 53-73, 121-165, |
| 420 | G24 | AP2 | 25-92 |
| 826 | G38 | AP2 | 76-143 |
| 828 | G44 | AP2 | 85-154 |
| 830 | G230 | MYB-(R1)R2R3 | 13-114 |
| 480 | G234 | MYB-(R1)R2R3 | 14-115 |
| 832 | G261 | HS | 15-106 |
| 834 | G271 | AKR | 41-106, 325-363, |
| 226 | G303 | HLH/MYC | 92-161 |
| 836 | G359 | Z-C2H2 | 49-69 |
| 838 | G377 | RING/C3H2C3 | 85-128 |
| 840 | G388 | HB | 98-158 |
| 842 | G435 | HB | 4-67 |
| 844 | G442 | AP2 | 66-138 |
| 846 | G468 | IAA | 86-102, 141-171, |
| 848 | G571 | bZIP | 160-220, 441-452, |
| 850 | G652 | Z-CLDSH | 28-49, 137-151, 182-196, |
| 852 | G664 | MYB-(R1)R2R3 | 14-116 |
| 854 | G772 | NAC | 27-176 |
| 856 | G798 | Z-Dof | 19-47 |
| 858 | G818 | HS | 71-162 |
| 434 | G971 | AP2 | 120-186 |
| 860 | G974 | AP2 | 80-147 |
| 436 | G988 | SCR | 146-217, 278-366, 370-444, |
| 862 | G1062 | HLH/MYC | 308-359 |
| 240 | G1069 | AT-hook | 67-74 |
| 864 | G1129 | HLH/MYC | 171-244 |

TABLE 4-continued

Gene families and conserved domains

| Polypeptide SEQ ID NO: | Identifier | Family | Conserved Domains in Amino Acid Coordinates |
|---|---|---|---|
| 866 | G1137 | HLH/MYC | 264-314 |
| 868 | G1425 | NAC | 20-173 |
| 870 | G1517 | RING/C3HC4 | 312-349 |
| 872 | G1655 | HLH/MYC | 134-192 |
| 874 | G1743 | RING/C3H2C3 | 94-136 |
| 876 | G1789 | MYB-related | 12-62 |
| 878 | G1806 | bZIP | 165-225 |
| 880 | G1911 | MYB-related | 12-62 |
| 882 | G2011 | HS | 55-146 |
| 316 | G2155 | AT-hook | 18-38 |
| 884 | G2215 | bZIP-NIN | 150-246 |
| 886 | G2452 | MYB-related | 28-79, 146-194, |
| 888 | G2455 | YABBY | 10-48, 107-154, |
| 890 | G2510 | AP2 | 42-109 |
| 892 | G2515 | MADS | 1-57 |
| 894 | G2571 | AP2 | 133-200 |
| 896 | G2702 | MYB-(R1)R2R3 | 31-131 |
| 898 | G2763 | HLH/MYC | 140-210 |
| 900 | G2774 | HLH/MYC | 157-227 |
| 892 | G2888 | Z-C2H2 | 41-61, 120-140, |
| 904 | G2958 | IAA | 88-104, 143-172, |
| 906 | G5 | AP2 | 149-216 |
| 572 | G12 | AP2 | 27-94 |
| 908 | G197 | MYB-(R1)R2R3 | 14-116 |
| 910 | G207 | MYB-(R1)R2R3 | 6-106 |
| 912 | G227 | MYB-(R1)R2R3 | 13-112 |
| 586 | G232 | MYB-(R1)R2R3 | 14-115 |
| 914 | G242 | MYB-(R1)R2R3 | 6-105 |
| 916 | G255 | MYB-(R1)R2R3 | 14-116 |
| 918 | G265 | HS | 13-104 |
| 920 | G361 | Z-C2H2 | 43-63 |
| 922 | G362 | Z-C2H2 | 62-82 |
| 924 | G370 | Z-C2H2 | 97-117 |
| 926 | G504 | NAC | 16-178 |
| 928 | G554 | bZIP | 82-142 |
| 930 | G555 | bZIP | 38-110 |
| 932 | G556 | bZIP | 83-143 |
| 934 | G558 | bZIP | 45-105 |
| 936 | G578 | bZIP | 36-96 |
| 264 | G596 | AT-hook | 89-96 |
| 938 | G629 | bZIP | 92-152 |
| 622 | G759 | NAC | 17-159 |
| 430 | G773 | NAC | 17-159 |
| 940 | G776 | NAC | 27-175 |
| 942 | G812 | HS | 29-120 |
| 634 | G914 | AP2 | 106-162, 198-238, |
| 944 | G997 | MYB-related | 9-59 |
| 946 | G1133 | HLH/MYC | 256-326 |
| 948 | G1141 | AP2 | 75-142 |
| 950 | G1198 | bZIP | 173-223 |
| 648 | G1277 | AP2 | 18-85 |
| 952 | G1335 | Z-CLDSH | 24-43, 131-144, 185-203, |
| 654 | G1379 | AP2 | 18-85 |
| 954 | G1454 | NAC | 9-178 |
| 956 | G1664 | HLH/MYC | 258-328 |
| 958 | G1897 | Z-Dof | 34-62 |
| 314 | G1945 | AT-hook | 49-71 |
| 960 | G1991 | Z-C2H2 | 6-26, 175-195, 224-226, |
| 282 | G2153 | AT-hook | 75-94, 162-206, |
| 962 | G2216 | bZIP-NIN | 90-139 |
| 964 | G2546 | HB | 349-413 |
| 966 | G2586 | WRKY | 103-160 |
| 968 | G2587 | WRKY | 108-165 |
| 970 | G2635 | NAC | 8-161 |
| 972 | G2639 | SRS | 114-167 |
| 974 | G2642 | SRS | 54-97 |
| 976 | G2721 | MYB-related | 10-60 |
| 978 | G2826 | Z-C2H2 | 75-95 |
| 980 | G2838 | Z-C2H2 | 57-77 |
| 982 | G2866 | IAA | 84-100, 139-168, |
| 344 | G3401 | AT-hook | 35-41, 43-186, |
| 346 | G3403 | AT-hook | 58-64, 66-207, |
| 348 | G3408 | AT-hook | 83-89, 91-247, |
| 384 | G3456 | AT-hook | 44-50, 52-195, |
| 392 | G3462 | AT-hook | 82-88, 90-237, |
| 984 | G3503 | MYB-(R1)R2R3 | 14-116 |
| 986 | G3504 | MYB-(R1)R2R3 | 14-116 |
| 988 | G3505 | MYB-(R1)R2R3 | 14-116 |
| 990 | G3506 | MYB-(R1)R2R3 | 14-116 |
| 992 | G3507 | MYB-(R1)R2R3 | 14-116 |
| 994 | G3508 | MYB-(R1)R2R3 | 14-116 |
| 996 | G3509 | MYB-(R1)R2R3 | 14-116 |
| 998 | G3527 | MYB-(R1)R2R3 | 13-117 |
| 1000 | G3528 | MYB-(R1)R2R3 | 13-117 |
| 1002 | G3529 | MYB-(R1)R2R3 | 14-116 |
| 1004 | G3531 | MYB-(R1)R2R3 | 14-116 |
| 1006 | G3532 | MYB-(R1)R2R3 | 14-116 |
| 1008 | G3533 | MYB-(R1)R2R3 | 14-116 |
| 1010 | G3534 | MYB-(R1)R2R3 | 14-116 |
| 412 | G3556 | AT-hook | 45-51, 53-196, |
| 806 | G3656 | AP2 | 23-86 |
| 1012 | G3809 | NAC | 25-236 |

Producing Polypeptides

The polynucleotides of the invention include sequences that encode transcription factors and transcription factor homolog polypeptides and sequences complementary thereto, as well as unique fragments of coding sequence, or sequence complementary thereto. Such polynucleotides can be, for example, DNA or RNA, the latter including mRNA, cRNA, synthetic RNA, genomic DNA, cDNA synthetic DNA, oligonucleotides, etc. The polynucleotides are either double-stranded or single-stranded, and include either, or both sense (i.e., coding) sequences and antisense (i.e., non-coding, complementary) sequences. The polynucleotides include the coding sequence of a transcription factor, or transcription factor homolog polypeptide, in isolation, in combination with additional coding sequences (for example, a purification tag, a localization signal, as a fusion-protein, as a pre-protein, or the like), in combination with non-coding sequences (for example, introns or inteins, regulatory elements such as promoters, enhancers, terminators, and the like), and/or in a vector or host environment in which the polynucleotide encoding a transcription factor or transcription factor homolog polypeptide is an endogenous or exogenous gene.

A variety of methods exist for producing the polynucleotides of the invention. Procedures for identifying and isolating DNA clones are well known to those of skill in the art, and are described in, for example, Berger and Kimmel, *Guide to Molecular Cloning Techniques, Methods in Enzymology*, vol. 152 Academic Press, Inc., San Diego, Calif. ("Berger"); Sambrook et al. *Molecular Cloning—A Laboratory Manual* (2nd ed.), Vol. 1-3, Cold Spring Harbor Laboratory, Cold Spring Harbor, N.Y., 1989 ("Sambrook") and *Current Protocols in Molecular Biology*, Ausubel et al. eds., Current Protocols, a joint venture between Greene Publishing Associates, Inc. and John Wiley & Sons, Inc., (supplemented through 2000) ("Ausubel").

Alternatively, polynucleotides of the invention, can be produced by a variety of in vitro amplification methods adapted to the present invention by appropriate selection of specific or degenerate primers. Examples of protocols sufficient to direct persons of skill through in vitro amplification methods, including the polymerase chain reaction (PCR) the ligase chain reaction (LCR), Qβ-replicase amplification and other RNA polymerase mediated techniques (for example, NASBA), for example, for the production of the homologous nucleic acids of the invention are found in Berger (supra), Sambrook (supra), and Ausubel (supra), as well as Mullis et al. (1987) *PCR Protocols A Guide to Methods and Applications* (Innis et al. eds) Academic Press Inc. San Diego, Calif. (1990) (Innis). Improved methods for cloning in vitro amplified nucleic acids are described in Wallace et al. U.S. Pat. No. 5,426,039. Improved methods for amplifying large nucleic acids by PCR are summarized in Cheng et al. (1994) *Nature* 369: 684-685 and the references cited therein, in which PCR amplicons of up to 40 kb are generated. One of skill will appreciate that essentially any RNA can be converted into a double-stranded DNA suitable for restriction digestion, PCR expansion and sequencing using reverse transcriptase and a polymerase (for example, in Ausubel, Sambrook and Berger, all supra).

Alternatively, polynucleotides and oligonucleotides of the invention can be assembled from fragments produced by solid-phase synthesis methods. Typically, fragments of up to approximately 100 bases are individually synthesized and then enzymatically or chemically ligated to produce a desired sequence, for example, a polynucleotide encoding all or part of a transcription factor. For example, chemical synthesis using the phosphoramidite method is described, for example, by Beaucage et al. (1981) *Tetrahedron Letters* 22: 1859-1869; and Matthes et al. (1984) *EMBO J.* 3: 801-805. According to such methods, oligonucleotides are synthesized, purified, annealed to their complementary strand, ligated and then optionally cloned into suitable vectors. And if so desired, the polynucleotides and polypeptides of the invention can be custom ordered from any of a number of commercial suppliers.

Homologous Sequences Sequences homologous, i.e., that share significant sequence identity or similarity, to those provided in the Sequence Listing, derived from *Arabidopsis thaliana* or from other plants of choice, are also an aspect of the invention. Homologous sequences can be derived from any plant including monocots and dicots and in particular agriculturally important plant species, including but not limited to, crops such as soybean, wheat, corn (maize), potato, cotton, rice, rape, oilseed rape (including canola), sunflower, alfalfa, clover, sugarcane, and turf; or fruits and vegetables, such as banana, blackberry, blueberry, strawberry, and raspberry, cantaloupe, carrot, cauliflower, coffee, cucumber, eggplant, grapes, honeydew, lettuce, mango, melon, onion, papaya, peas, peppers, pineapple, pumpkin, spinach, squash, sweet corn, tobacco, tomato, tomatillo, watermelon, rosaceous fruits (such as apple, peach, pear, cherry and plum) and vegetable brassicas (such as broccoli, cabbage, cauliflower, Brussels sprouts, and kohlrabi). Other crops, including fruits and vegetables, whose phenotype can be changed and which comprise homologous sequences include barley; rye; millet; *sorghum*; currant; avocado; citrus fruits such as oranges, lemons, grapefruit and tangerines, artichoke, cherries; nuts such as the walnut and peanut; endive; leek; roots such as arrowroot, beet, cassava, turnip, radish, yam, and sweet potato; and beans. The homologous sequences may also be derived from woody species, such as pine, poplar and eucalyptus, or mint or other labiates. In addition, homologous sequences may be derived from plants that are evolutionarily related to crop plants, but which may not have yet been used as crop plants. Examples include deadly nightshade (*Atropa belladona*), related to tomato; jimson weed (*Datura strommium*), related to peyote; and teosinte (*Zea* species), related to corn (maize).

Orthologs and Paralogs

Homologous sequences as described above can comprise orthologous or paralogous sequences. Several different methods are known by those of skill in the art for identifying and defining these functionally homologous sequences. Three general methods for defining orthologs and paralogs are described; an ortholog, paralog or homolog may be identified by one or more of the methods described below.

Within a single plant species, gene duplication may cause two copies of a particular gene, giving rise to two or more genes with similar sequence and often similar function known as paralogs. A paralog is therefore a similar gene formed by duplication within the same species. Paralogs typically cluster together or in the same clade (a group of similar genes) when a gene family phylogeny is analyzed using programs such as CLUSTAL (Thompson et al. (1994) *Nucleic Acids Res.* 22: 4673-4680; Higgins et al. (1996) *Methods Enzymol.* 266: 383-402). Groups of similar genes can also be identified with pair-wise BLAST analysis (Feng and Doolittle (1987) *J. Mol. Evol.* 25: 351-360). For example, a clade of very similar MADS domain transcription factors from *Arabidopsis* all share a common function in flowering time (Ratcliffe et al. (2001) *Plant Physiol.* 126: 122-132), and a group of very similar AP2 domain transcription factors from *Arabidopsis* are involved in tolerance of plants to freezing (Gilmour et al. (1998) *Plant J.* 16: 433-442). Analysis of groups of similar genes with similar function that fall within one clade can yield sub-sequences that are particular to the clade. These sub-sequences, known as consensus sequences, can not only be used to define the sequences within each clade, but define the functions of these genes; genes within a clade may contain paralogous sequences, or orthologous sequences that share the same function (for example, in Mount (2001), in *Bioinformatics: Sequence and Genome Analysis* Cold Spring Harbor Laboratory Press, Cold Spring Harbor, N.Y., page 543).

Speciation, the production of new species from a parental species, can also give rise to two or more genes with similar sequence and similar function. These genes, termed orthologs, often have an identical function within their host plants and are often interchangeable between species without losing function. Because plants have common ancestors, many genes in any plant species will have a corresponding orthologous gene in another plant species. Once a phylogenic tree for a gene family of one species has been constructed using a program such as CLUSTAL (Thompson et al. (1994) *Nucleic Acids Res.* 22: 4673-4680; Higgins et al. (1996) supra) potential orthologous sequences can be placed into the phylogenetic tree and their relationship to genes from the species of interest can be determined. Orthologous sequences can also be identified by a reciprocal BLAST strategy. Once an orthologous sequence has been identified, the function of the ortholog can be deduced from the identified function of the reference sequence.

Transcription factor gene sequences are conserved across diverse eukaryotic species lines (Goodrich et al. (1993) *Cell* 75: 519-530; Lin et al. (1991) *Nature* 353: 569-571; Sadowski et al. (1988) *Nature* 335: 563-564). Plants are no exception to this observation; diverse plant species possess transcription factors that have similar sequences and functions.

Orthologous genes from different organisms have highly conserved functions, and very often essentially identical functions (Lee et al. (2002) *Genome Res.* 12: 493-502; Remm et al. (2001) *J. Mol. Biol.* 314: 1041-1052). Paralogous genes, which have diverged through gene duplication, may retain similar functions of the encoded proteins. In such cases, paralogs can be used interchangeably with respect to certain embodiments of the instant invention (for example, transgenic expression of a coding sequence). An example of such highly related paralogs is the CBF family, with four well-defined members in *Arabidopsis* (CBF 1, CBF2, CBF3 and CBF4) and at least one ortholog in *Brassica napus*, all of which control pathways involved in both freezing and drought stress (Gilmour et al. (1998) *Plant J.* 16: 433-442; Jaglo et al. (1998) *Plant Physiol.* 127: 910-917).

The following references represent a small sampling of the many studies that demonstrate that conserved transcription factor genes from diverse species are likely to function similarly (i.e., regulate similar target sequences and control the same traits), and that transcription factors may be transformed into diverse species to confer or improve traits.

(1) Distinct *Arabidopsis* transcription factors, including G28 (U.S. Pat. No. 6,664,446), G482 (US Patent Application 20040045049; SEQ ID NO: 290 in the present Sequence Listing), G867 (US Patent Application 20040098764; SEQ ID NO: 630 in the present Sequence Listing), and G1073 (US Patent Application 20040128712; SEQ ID NO: 300 in the present Sequence Listing), have been shown to confer abiotic stress tolerance when the sequences are overexpressed. The polypeptides sequences belong to distinct clades of transcription factor polypeptides that include members from diverse species. In each case, a significant number of sequences derived from both dicots and monocots have been shown to confer tolerance to various abiotic stresses when the sequences were overexpressed.

(2) The *Arabidopsis* NPR1 gene regulates systemic acquired resistance (SAR) (Cao et al. (1997) *Cell* 88: 57-63); over-expression of NPR1 leads to enhanced resistance in *Arabidopsis*. When either *Arabidopsis* NPR1 or the rice NPR1 ortholog was overexpressed in rice (which, as a monocot, is diverse from *Arabidopsis*), challenge with the rice bacterial blight pathogen *Xanthomonas oryzae* pv. *Oryzae*, the transgenic plants displayed enhanced resistance (Chern et al. (2001) *Plant J.* 27: 101-113). NPR1 acts through activation of expression of transcription factor genes, such as TGA2 (Fan and Dong (2002) *Plant Cell* 14: 1377-1389).

(3) E2F genes are involved in transcription of plant genes for proliferating cell nuclear antigen (PCNA). Plant E2Fs share a high degree of similarity in amino acid sequence between monocots and dicots, and are even similar to the conserved domains of the animal E2Fs. Such conservation indicates a functional similarity between plant and animal E2Fs. E2F transcription factors that regulate meristem development act through common cis-elements, and regulate related (PCNA) genes (Kosugi and Ohashi, (2002) *Plant J.* 29: 45-59).

(4) The ABI5 gene (ABA insensitive 5) encodes a basic leucine zipper factor required for ABA response in the seed and vegetative tissues. Co-transformation experiments with ABI5 cDNA constructs in rice protoplasts resulted in specific transactivation of the ABA-inducible wheat, *Arabidopsis*, bean, and barley promoters. These results demonstrate that sequentially similar ABI5 transcription factors are key targets of a conserved ABA signaling pathway in diverse plants. (Gampala et al. (2001) *J. Biol. Chem.* 277: 1689-1694).

(5) Sequences of three *Arabidopsis* GAMYB-like genes were obtained on the basis of sequence similarity to GAMYB genes from barley, rice, and *L. temulentum*. These three *Arabidopsis* genes were determined to encode transcription factors (AtMYB33, AtMYB65, and AtMYB101) and could substitute for a barley GAMYB and control α-amylase expression (Gocal et al. (2001) *Plant Physiol.* 127: 1682-1693).

(6) The floral control gene LEAFY from *Arabidopsis* can dramatically accelerate flowering in numerous dictoyledonous plants. Constitutive expression of *Arabidopsis* LEAFY also caused early flowering in transgenic rice (a monocot), with a heading date that was 26-34 days earlier than that of wild-type plants. These observations indicate that floral regulatory genes from *Arabidopsis* are useful tools for heading date improvement in cereal crops (He et al. (2000) *Transgenic Res.* 9: 223-227).

(7) Bioactive gibberellins (GAs) are essential endogenous regulators of plant growth. GA signaling tends to be conserved across the plant kingdom. GA signaling is mediated via GAI, a nuclear member of the GRAS family of plant transcription factors. *Arabidopsis* GAI has been shown to function in rice to inhibit gibberellin response pathways (Fu et al. (2001) *Plant Cell* 13: 1791-1802).

(8) The *Arabidopsis* gene SUPERMAN (SUP), encodes a putative transcription factor that maintains the boundary between stamens and carpels. By over-expressing *Arabidopsis* SUP in rice, the effect of the gene's presence on whorl boundaries was shown to be conserved. This demonstrated that SUP is a conserved regulator of floral whorl boundaries and affects cell proliferation (Nandi et al. (2000) *Curr. Biol.* 10: 215-218).

(9) Maize, *petunia* and *Arabidopsis* myb transcription factors that regulate flavonoid biosynthesis are genetically similar and affect the same trait in their native species; therefore, sequence and function of these myb transcription factors correlate with each other in these diverse species (Borevitz et al. (2000) *Plant Cell* 12: 2383-2394).

(10) Wheat reduced height-1 (Rht-B1/Rht-D1) and maize dwarf-8 (d8) genes are orthologs of the *Arabidopsis* gibberellin insensitive (GAI) gene. Both of these genes have been used to produce dwarf grain varieties that have improved grain yield. These genes encode proteins that resemble nuclear transcription factors and contain an SH2-like domain, indicating that phosphotyrosine may participate in gibberellin signaling. Transgenic rice plants containing a mutant GAI allele from *Arabidopsis* have been shown to produce reduced responses to gibberellin and are dwarfed, indicating that mutant GAI orthologs could be used to increase yield in a wide range of crop species (Peng et al. (1999) *Nature* 400: 256-261).

Transcription factors that are homologous to the listed sequences will typically share at least about 70% amino acid sequence identity in their conserved domain. More closely related transcription factors can share at least about 79% or about 90% or about 95% or about 98% or more sequence identity with the listed sequences, or with the listed sequences but excluding or outside a known consensus sequence or consensus DNA-binding site, or with the listed sequences excluding one or all conserved domains. Factors that are most closely related to the listed sequences share, for example, at least about 85%, about 90% or about 95% or more % sequence identity to the listed sequences, or to the listed sequences but excluding or outside a known consensus sequence or consensus DNA-binding site or outside one or all conserved domain. At the nucleotide level, the sequences will typically share at least about 40% nucleotide sequence identity, preferably at least about 50%, about 60%, about 70% or about 80% sequence identity, and more preferably about 85%, about 90%, about 95% or about 97% or more sequence identity to one or more of the listed sequences, or to a listed sequence but excluding or outside a known consensus sequence or consensus DNA-binding site, or outside one or all conserved domain. The degeneracy of the genetic code enables major variations in the nucleotide sequence of a polynucleotide while maintaining the amino acid sequence of the encoded protein. AP2 domains within the AP2 transcription factor family may exhibit a higher degree of sequence homology, such as at least 70% amino acid sequence identity including conservative substitutions, and preferably at least 80% sequence identity, and more preferably at least 85%, or at least about 86%, or at least about 87%, or at least about 88%, or at least about 90%, or at least about 95%, or at least about 98% sequence identity. Transcription factors that are homologous to the listed sequences should share at least 30%, or at least about 60%, or at least about 75%, or at least about 80%, or at least about 90%, or at least about 95% amino acid sequence identity over the entire length of the polypeptide or the homolog.

Percent identity can be determined electronically, for example, by using the MEGALIGN program (DNASTAR, Inc. Madison, Wis.). The MEGALIGN program can create alignments between two or more sequences according to different methods, for example, the clustal method (for example, in Higgins and Sharp (1988) *Gene* 73: 237-244). The clustal algorithm groups sequences into clusters by examining the distances between all pairs. The clusters are aligned pairwise and then in groups. Other alignment algorithms or programs may be used, including FASTA, BLAST, or ENTREZ, FASTA and BLAST, and which may be used to calculate percent similarity. These are available as a part of the GCG sequence analysis package (University of Wisconsin, Madison, Wis.), and can be used with or without default settings. ENTREZ is available through the National Center for Biotechnology Information. In one embodiment, the percent identity of two sequences can be determined by the GCG program with a gap weight of 1, for example, each amino acid gap is weighted as if it were a single amino acid or nucleotide mismatch between the two sequences (U.S. Pat. No. 6,262,333).

Other techniques for alignment are described in Methods in Enzymology, vol. 266, *Computer Methods for Macromolecular Sequence Analysis* (1996), ed. Doolittle, Academic Press, Inc., San Diego, Calif., USA. Preferably, an alignment program that permits gaps in the sequence is utilized to align the sequences. The Smith-Waterman is one type of algorithm that permits gaps in sequence alignments (Shpaer (1997) *Methods Mol. Biol.* 70: 173-187). Also, the GAP program using the Needleman and Wunsch alignment method can be utilized to align sequences. An alternative search strategy uses MPSRCH software, which runs on a MASPAR computer. MPSRCH uses a Smith-Waterman algorithm to score sequences on a massively parallel computer. This approach improves ability to pick up distantly related matches, and is especially tolerant of small gaps and nucleotide sequence errors. Nucleic acid-encoded amino acid sequences can be used to search both protein and DNA databases.

The percentage similarity between two polypeptide sequences, for example, sequence A and sequence B, is calculated by dividing the length of sequence A, minus the number of gap residues in sequence A, minus the number of gap residues in sequence B, into the sum of the residue matches between sequence A and sequence B, times one hundred. Gaps of low or of no similarity between the two amino acid sequences are not included in determining percentage similarity. Percent identity between polynucleotide sequences can also be counted or calculated by other methods known in the art, for example, the Jotun Hein method (for example, in Hein (1990) *Methods Enzymol.* 183: 626-645). Identity between sequences can also be determined by other methods known in the art, for example, by varying hybridization conditions (US Patent Application No. 20010010913).

Thus, the invention provides methods for identifying a sequence similar or paralogous or orthologous or homologous to one or more polynucleotides as noted herein, or one or more target polypeptides encoded by the polynucleotides, or otherwise noted herein and may include linking or associating a given plant phenotype or gene function with a sequence. In the methods, a sequence database is provided (locally or across an internet or intranet) and a query is made against the sequence database using the relevant sequences herein and associated plant phenotypes or gene functions.

In addition, one or more polynucleotide sequences or one or more polypeptides encoded by the polynucleotide sequences may be used to search against a BLOCKS (Bairoch et al. (1997) *Nucleic Acids Res.* 25: 217-221), PFAM, and other databases which contain previously identified and annotated motifs, sequences and gene functions. Methods that search for primary sequence patterns with secondary structure gap penalties (Smith et al. (1992) *Protein Engineering* 5: 35-51) as well as algorithms such as Basic Local Alignment Search Tool (BLAST; Altschul (1993) *J. Mol. Evol.* 36: 290-300; Altschul et al. (1990) *J. Mol. Biol.* 215: 403-410), BLOCKS (Henikoff and Henikoff (1991) *Nucleic Acids Res.* 19: 6565-6572), Hidden Markov Models (HMM; Eddy (1996) *Curr. Opin. Str. Biol.* 6: 361-365; Sonnhammer et al. (1997) *Proteins* 28: 405-420), and the like, can be used to manipulate and analyze polynucleotide and polypeptide sequences encoded by polynucleotides. These databases, algorithms and other methods are well known in the art and are described in Ausubel et al. (1997) *Short Protocols in Molecular Biology*, John Wiley & Sons, New York, N.Y., unit 7.7) and in Meyers (1995) *Molecular Biology and Biotechnology*, Wiley VCH, New York, N.Y., p 856-853).

A further method for identifying or confirming that specific homologous sequences control the same function is by comparison of the transcript profile(s) obtained upon overexpression or knockout of two or more related transcription factors. Since transcript profiles are diagnostic for specific cellular states, one skilled in the art will appreciate that genes that have a highly similar transcript profile (for example, with greater than 50% regulated transcripts in common, more preferably with greater than 70% regulated transcripts in common, most preferably with greater than 90% regulated transcripts in common) will have highly similar functions. Fowler et al. (2002) *Plant Cell* 14: 1675-1679) have shown that three paralogous AP2 family genes (CBF1, CBF2 and CBF3), each of which is induced upon cold treatment, and each of which can condition improved freezing tolerance, have highly similar transcript profiles. Once a transcription factor has been shown to provide a specific function, its transcript profile becomes a diagnostic tool to determine whether putative paralogs or orthologs have the same function.

Furthermore, methods using manual alignment of sequences similar or homologous to one or more polynucleotide sequences or one or more polypeptides encoded by the polynucleotide sequences may be used to identify regions of similarity and AP2 binding domains. Such manual methods are well-known of those of skill in the art and can include, for example, comparisons of tertiary structure between a polypeptide sequence encoded by a polynucleotide that comprises a known function with a polypeptide sequence encoded by a polynucleotide sequence which has a function not yet determined. Such examples of tertiary structure may comprise predicted α-helices, β-sheets, amphipathic helices, leucine zipper motifs, zinc finger motifs, proline-rich regions, cysteine repeat motifs, and the like.

Orthologs and paralogs of presently disclosed transcription factors may be cloned using compositions provided by the present invention according to methods well known in the art. cDNAs can be cloned using mRNA from a plant cell or tissue that expresses one of the present transcription factors. Appropriate mRNA sources may be identified by interrogating Northern blots with probes designed from the present transcription factor sequences, after which a library is prepared from the mRNA obtained from a positive cell or tissue. Transcription factor-encoding cDNA is then isolated using, for example, PCR, using primers designed from a presently disclosed transcription factor gene sequence, or by probing with a partial or complete cDNA or with one or more sets of degenerate probes based on the disclosed sequences. The cDNA library may be used to transform plant cells. Expression of the cDNAs of interest is detected using, for example, methods disclosed herein such as microarrays, Northern blots, quantitative PCR, or any other technique for monitoring changes in expression. Genomic clones may be isolated using similar techniques to those.

Identifying Polynucleotides or Nucleic Acids by Hybridization

Polynucleotides homologous to the sequences illustrated in the Sequence Listing and tables can be identified, for example, by hybridization to each other under stringent or under highly stringent conditions. Single-stranded polynucleotides hybridize when they associate based on a variety of well characterized physical-chemical forces, such as hydrogen bonding, solvent exclusion, base stacking and the like. The stringency of a hybridization reflects the degree of sequence identity of the nucleic acids involved, such that the higher the stringency, the more similar are the two polynucleotide strands. Stringency is influenced by a variety of factors, including temperature, salt concentration and composition, organic and non-organic additives, solvents, etc. present in both the hybridization and wash solutions and incubations (and number thereof), as described in more detail in the references cited above.

Stability of DNA duplexes is affected by such factors as base composition, length, and degree of base pair mismatch. Hybridization conditions may be adjusted to allow DNAs of different sequence relatedness to hybridize. The melting temperature ($T_m$) is defined as the temperature when 50% of the duplex molecules have dissociated into their constituent single strands. The melting temperature of a perfectly matched duplex, where the hybridization buffer contains formamide as a denaturing agent, may be estimated by the following equations:

$T_m(° C.)=81.5+16.6(\log [Na+])+0.41(\% G+C)- 0.62(\% \text{ formamide})-500/L$     (I) DNA-DNA:

$T_m(° C.)=79.8+18.5(\log [Na+])+0.58(\% G+C)+ 0.12(\% G+C)^2-0.5(\% \text{ formamide})-820/L$     (II) DNA-RNA:

$T_m(° C.)=79.8+18.5(\log [Na+])+0.58(\% G+C)+ 0.12(\% G+C)^2-0.35(\% \text{ formamide})-820/L$     (III) RNA-RNA:

where L is the length of the duplex formed, [Na+] is the molar concentration of the sodium ion in the hybridization or washing solution, and % G+C is the percentage of (guanine+cytosine) bases in the hybrid. For imperfectly matched hybrids, approximately 1° C. is required to reduce the melting temperature for each 1% mismatch.

Hybridization experiments are generally conducted in a buffer of pH between 6.8 to 7.4, although the rate of hybridization is nearly independent of pH at ionic strengths likely to be used in the hybridization buffer (Anderson and Young (1985) "Quantitative Filter Hybridisation." In: Hames and Higgins, ed., *Nucleic Acid Hybridisation, A Practical Approach*. Oxford, IRL Press, 73-111). In addition, one or more of the following may be used to reduce non-specific hybridization: sonicated salmon sperm DNA or another non-complementary DNA, bovine serum albumin, sodium pyrophosphate, sodium dodecylsulfate (SDS), polyvinyl-pyrrolidone, ficoll and Denhardt's solution. Dextran sulfate and polyethylene glycol 6000 act to exclude DNA from solution, thus raising the effective probe DNA concentration and the hybridization signal within a given unit of time. In some instances, conditions of even greater stringency may be desirable or required to reduce non-specific and/or background hybridization. These conditions may be created with the use of higher temperature, lower ionic strength and higher concentration of a denaturing agent such as formamide.

Stringency conditions can be adjusted to screen for moderately similar fragments such as homologous sequences from distantly related organisms, or to highly similar fragments such as genes that duplicate functional enzymes from closely related organisms. The stringency can be adjusted either during the hybridization step or in the post-hybridization washes. Salt concentration, formamide concentration, hybridization temperature and probe lengths are variables that can be used to alter stringency (as described by the formula above). As a general guidelines high stringency is typically performed at $T_m-5°$ C. to $T_m-20°$ C., moderate stringency at $T_m-20°$ C. to $T_m-35°$ C. and low stringency at $T_m-35°$ C. to $T_m-50°$ C. for duplex >150 base pairs. Hybridization may be performed at low to moderate stringency (25-50° C. below $T_m$), followed by post-hybridization washes at increasing stringencies. Maximum rates of hybridization in solution are determined empirically to occur at $T_m-25°$ C. for DNA-DNA duplex and $T_m-15°$ C. for RNA-DNA duplex. Optionally, the degree of dissociation may be assessed after each wash step to determine the need for subsequent, higher stringency wash steps.

High stringency conditions may be used to select for nucleic acid sequences with high degrees of identity to the disclosed sequences. An example of stringent hybridization conditions obtained in a filter-based method such as a Southern or northern blot for hybridization of complementary nucleic acids that have more than 100 complementary residues is about 5° C. to 20° C. lower than the thermal melting point ($T_m$) for the specific sequence at a defined ionic strength and pH. Conditions used for hybridization may include about 0.02 M to about 0.15 M sodium chloride, about 0.5% to about 5% casein, about 0.02% SDS or about 0.1% N-laurylsarcosine, about 0.001 M to about 0.03 M sodium citrate, at hybridization temperatures between about 50° C. and about 70° C. More preferably, high stringency conditions are about 0.02 M sodium chloride, about 0.5% casein, about 0.02% SDS, about 0.001 M sodium citrate, at a temperature of about 50° C. Nucleic acid molecules that hybridize under stringent conditions will typically hybridize to a probe based on either the entire DNA molecule or selected portions, for example, to a unique subsequence, of the DNA.

Stringent salt concentration will ordinarily be less than about 750 mM NaCl and 75 mM trisodium citrate. Increasingly stringent conditions may be obtained with less than about 500 mM NaCl and 50 mM trisodium citrate, to even greater stringency with less than about 250 mM NaCl and 25 mM trisodium citrate. Low stringency hybridization can be obtained in the absence of organic solvent, for example, formamide, whereas high stringency hybridization may be obtained in the presence of at least about 35% formamide, and more preferably at least about 50% formamide. Stringent temperature conditions will ordinarily include temperatures of at least about 30° C., more preferably of at least about 37° C., and most preferably of at least about 42° C. with formamide present. Varying additional parameters, such as hybridization time, the concentration of detergent, for example, sodium dodecyl sulfate (SDS) and ionic strength, are well known to those skilled in the art. Various levels of stringency are accomplished by combining these various conditions as needed.

The washing steps that follow hybridization may also vary in stringency; the post-hybridization wash steps primarily determine hybridization specificity, with the most critical factors being temperature and the ionic strength of the final wash solution. Wash stringency can be increased by decreasing salt concentration or by increasing temperature. Stringent salt concentration for the wash steps will preferably be less than about 30 mM NaCl and 3 mM trisodium citrate, and most preferably less than about 15 mM NaCl and 1.5 mM trisodium citrate.

Thus, hybridization and wash conditions that may be used to bind and remove polynucleotides with less than the desired homology to the nucleic acid sequences or their complements that encode the present transcription factors include, for example:

6×SSC at 65° C.;
50% formamide, 4×SSC at 42° C.; or
0.5×SSC, 0.1% SDS at 65° C.;

with, for example, two wash steps of 10-30 minutes each. Useful variations on these conditions will be readily apparent to those skilled in the art.

A person of skill in the art would not expect substantial variation among polynucleotide species encompassed within the scope of the present invention because the highly stringent conditions set forth in the above formulae yield structurally similar polynucleotides.

If desired, one may employ wash steps of even greater stringency, including about 0.2×SSC, 0.1% SDS at 65° C. and washing twice, each wash step being about 30 min, or about 0.1×SSC, 0.1% SDS at 65° C. and washing twice for 30 min. The temperature for the wash solutions will ordinarily be at least about 25° C., and for greater stringency at least about 42° C. Hybridization stringency may be increased further by using the same conditions as in the hybridization steps, with the wash temperature raised about 3° C. to about 5° C., and stringency may be increased even further by using the same conditions except the wash temperature is raised about 6° C. to about 9° C. For identification of less closely related homologs, wash steps may be performed at a lower temperature, for example, 50° C.

An example of a low stringency wash step employs a solution and conditions of at least 25° C. in 30 mM NaCl, 3 mM trisodium citrate, and 0.1% SDS over 30 min. Greater stringency may be obtained at 42° C. in 15 mM NaCl, with 1.5 mM trisodium citrate, and 0.1% SDS over 30 min. Even higher stringency wash conditions are obtained at 65° C.-68° C. in a solution of 15 mM NaCl, 1.5 mM trisodium citrate, and 0.1% SDS. Wash procedures will generally employ at least two final wash steps. Additional variations on these conditions will be readily apparent to those skilled in the art (for example, in US Patent Application No. 20010010913).

Stringency conditions can be selected such that an oligonucleotide that is perfectly complementary to the coding oligonucleotide hybridizes to the coding oligonucleotide with at least about a 5-10× higher signal to noise ratio than the ratio for hybridization of the perfectly complementary oligonucleotide to a nucleic acid encoding a transcription factor known as of the filing date of the application. It may be desirable to select conditions for a particular assay such that a higher signal to noise ratio, that is, about 15× or more, is obtained. Accordingly, a subject nucleic acid will hybridize to a unique coding oligonucleotide with at least a 2× or greater signal to noise ratio as compared to hybridization of the coding oligonucleotide to a nucleic acid encoding known polypeptide. The particular signal will depend on the label used in the relevant assay, for example, a fluorescent label, a colorimetric label, a radioactive label, or the like. Labeled hybridization or PCR probes for detecting related polynucleotide sequences may be produced by oligolabeling, nick translation, end-labeling, or PCR amplification using a labeled nucleotide.

Encompassed by the invention are polynucleotide sequences that are capable of hybridizing to the polynucleotide sequences of the Sequence Listing, and fragments thereof under various conditions of stringency (for example, in Wahl and Berger (1987) *Methods Enzymol.* 152: 399-407, and Kimmel (1987) *Methods Enzymol.* 152: 507-511). Estimates of homology are provided by either DNA-DNA or DNA-RNA hybridization under conditions of stringency as is well understood by those skilled in the art (Hames and Higgins, Eds. (1985) *Nucleic Acid Hybridisation: A Practical Approach*, IRL Press, Oxford, U.K.). Stringency conditions can be adjusted to screen for moderately similar fragments, such as homologous sequences from distantly related organisms, to highly similar fragments, such as genes that duplicate functional enzymes from closely related organisms. Post-hybridization washes determine stringency conditions.

Identifying Polynucleotides or Nucleic Acids with Expression Libraries

In addition to hybridization methods, transcription factor homolog polypeptides can be obtained by screening an expression library using antibodies specific for one or more transcription factors. With the provision herein of the disclosed transcription factor, and transcription factor homolog nucleic acid sequences, the encoded polypeptide(s) can be expressed and purified in a heterologous expression system (for example, *E. coli*) and used to raise antibodies (monoclonal or polyclonal) specific for the polypeptide(s) in question. Antibodies can also be raised against synthetic peptides derived from the amino acid sequences or subsequences of a transcription factor or transcription factor homolog. Methods of raising antibodies are well known in the art and are described in Harlow and Lane (1988), *Antibodies: A Laboratory Manual*, Cold Spring Harbor Laboratory, New York. Such antibodies can then be used to screen an expression library produced from the plant from which it is desired to clone additional transcription factor homologs, using the methods described above. The selected cDNAs can be confirmed by sequencing and enzymatic activity.

Sequence Variations

It will readily be appreciated by those of skill in the art, that any of a variety of polynucleotide sequences are capable of encoding the transcription factors and transcription factor homolog polypeptides of the invention. Due to the degeneracy of the genetic code, many different polynucleotides can encode identical and/or substantially similar polypeptides in addition to those sequences illustrated in the Sequence Listing. Nucleic acids having a sequence that differs from the sequences shown in the Sequence Listing, or complementary sequences, that encode functionally equivalent peptides (i.e., peptides having some degree of equivalent or similar biological activity) but differ in sequence from the sequence shown in the Sequence Listing due to degeneracy in the genetic code, are also within the scope of the invention.

Altered polynucleotide sequences encoding polypeptides include those sequences with deletions, insertions, or substitutions of different nucleotides, resulting in a polynucleotide encoding a polypeptide with at least one functional characteristic of the instant polypeptides. Included within this definition are polymorphisms which may or may not be readily detectable using a particular oligonucleotide probe of the polynucleotide encoding the instant polypeptides, and improper or unexpected hybridization to allelic variants, with a locus other than the normal chromosomal locus for the polynucleotide sequence encoding the instant polypeptides.

Allelic variant refers to any of two or more alternative forms of a gene occupying the same chromosomal locus. Allelic variation arises naturally through mutation, and may result in phenotypic polymorphism within populations. Gene mutations can be silent (i.e., no change in the encoded polypeptide) or may encode polypeptides having altered amino acid sequence. The term allelic variant is also used herein to denote a protein encoded by an allelic variant of a gene. Splice variant refers to alternative forms of RNA transcribed from a gene. Splice variation arises naturally through use of alternative splicing sites within a transcribed RNA molecule, or less commonly between separately transcribed RNA molecules, and may result in several mRNAs transcribed from the same gene. Splice variants may encode polypeptides having altered amino acid sequence. The term splice variant is also used herein to denote a protein encoded by a splice variant of an mRNA transcribed from a gene.

Those skilled in the art would recognize that, for example, G2133, SEQ ID NO: 12, represents a single transcription factor; allelic variation and alternative splicing may be expected to occur. Allelic variants of SEQ ID NO: 11 can be cloned by probing cDNA or genomic libraries from different individual organisms according to standard procedures. Allelic variants of the DNA sequence shown in SEQ ID NO: 11, including those containing silent mutations and those in which mutations result in amino acid sequence changes, are within the scope of the present invention, as are proteins which are allelic variants of SEQ ID NO: 12. cDNAs generated from alternatively spliced mRNAs, which retain the properties of the transcription factor are included within the scope of the present invention, as are polypeptides encoded by such cDNAs and mRNAs. Allelic variants and splice variants of these sequences can be cloned by probing cDNA or genomic libraries from different individual organisms or tissues according to standard procedures known in the art (U.S. Pat. No. 6,388,064).

Thus, in addition to the sequences set forth in the Sequence Listing, the invention also encompasses related nucleic acid molecules that include allelic or splice variants of the sequences of the Sequence Listing, and include sequences that are complementary to any of the above nucleotide sequences. Related nucleic acid molecules also include nucleotide sequences encoding a polypeptide comprising a substitution, modification, addition and/or deletion of one or more amino acid residues compared to the polypeptide sequences of the Sequence Listing and equivalogs. Such related polypeptides may comprise, for example, additions and/or deletions of one or more N-linked or O-linked glycosylation sites, or an addition and/or a deletion of one or more cysteine residues.

For example, Table 5 illustrates, for example, that the codons AGC, AGT, TCA, TCC, TCG, and TCT all encode the same amino acid: serine. Accordingly, at each position in the sequence where there is a codon encoding serine, any of the above trinucleotide sequences can be used without altering the encoded polypeptide.

TABLE 5

| Amino acid | | | Possible Codons |
|---|---|---|---|
| Alanine | Ala | A | GCA GCC GCG GCT |
| Cysteine | Cys | C | TGC TGT |
| Aspartic acid | Asp | D | GAC GAT |
| Glutamic acid | Glu | E | GAA GAG |
| Phenylalanine | Phe | F | TTC TTT |
| Glycine | Gly | G | GGA GGC GGG GGT |
| Histidine | His | H | CAC CAT |
| Isoleucine | Ile | I | ATA ATC ATT |
| Lysine | Lys | K | AAA AAG |
| Leucine | Leu | L | TTA TTG CTA CTC CTG CTT |
| Methionine | Met | M | ATG |
| Asparagine | Asn | N | AAC AAT |
| Proline | Pro | P | CCA CCC CCG CCT |
| Glutamine | Gln | Q | CAA CAG |
| Arginine | Arg | R | AGA AGG CGA CGC CGG CGT |
| Serine | Ser | S | AGC AGT TCA TCC TCG TCT |
| Threonine | Thr | T | ACA ACC ACG ACT |
| Valine | Val | V | GTA GTC GTG GTT |
| Tryptophan | Trp | W | TGG |
| Tyrosine | Tyr | Y | TAC TAT |

Sequence alterations that do not change the amino acid sequence encoded by the polynucleotide are termed "silent" variations. With the exception of the codons ATG and TGG, encoding methionine and tryptophan, respectively, any of the possible codons for the same amino acid can be substituted by a variety of techniques, for example, site-directed mutagenesis, available in the art. Accordingly, any and all such variations of a sequence selected from the above table are a feature of the invention.

In addition to silent variations, other conservative variations that alter one, or a few amino acid residues in the encoded polypeptide, can be made without altering the function of the polypeptide, these conservative variants are, likewise, a feature of the invention.

For example, substitutions, deletions and insertions introduced into the sequences provided in the Sequence Listing, are also envisioned by the invention. Such sequence modifications can be engineered into a sequence by site-directed mutagenesis (Wu (ed.) *Methods Enzymol.* (1993) vol. 217, Academic Press) or the other methods noted below. Amino acid substitutions are typically of single residues; insertions usually will be on the order of about from 1 to 10 amino acid residues; and deletions will range about from 1 to 30 residues. In one embodiment, deletions or insertions are made in adjacent pairs, for example, a deletion of two residues or insertion of two residues. Substitutions, deletions, insertions or any combination thereof can be combined to arrive at a sequence. The mutations that are made in the polynucleotide encoding the transcription factor should not place the sequence out of reading frame and should not create complementary regions that could produce secondary mRNA structure. Preferably, the polypeptide encoded by the DNA performs the desired function.

Conservative substitutions are those in which at least one residue in the amino acid sequence has been removed and a different residue inserted in its place. Such substitutions generally are made in accordance with the Table 6 when it is desired to maintain the activity of the protein. Table 6 shows amino acids which can be substituted for an amino acid in a protein and which are typically regarded as conservative substitutions.

TABLE 6

| Residue | Conservative Substitutions |
|---------|---------------------------|
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Ser | Thr; Gly |
| Thr | Ser; Val |
| Trp | Tyr |
| Tyr | Trp; Phe |
| Val | Ile; Leu |

The polypeptides provided in the Sequence Listing have a novel activity, such as, for example, regulatory activity. Although all conservative amino acid substitutions (for example, one basic amino acid substituted for another basic amino acid) in a polypeptide will not necessarily result in the polypeptide retaining its activity, it is expected that many of these conservative mutations would result in the polypeptide retaining its activity. Most mutations, conservative or non-conservative, made to a protein but outside of a conserved domain required for function and protein activity will not affect the activity of the protein to any great extent.

Similar substitutions are those in which at least one residue in the amino acid sequence has been removed and a different residue inserted in its place. Such substitutions generally are made in accordance with the Table 7 when it is desired to maintain the activity of the protein. Table 7 shows amino acids which can be substituted for an amino acid in a protein and which are typically regarded as structural and functional substitutions. For example, a residue in column 1 of Table 7 may be substituted with a residue in column 2; in addition, a residue in column 2 of Table 7 may be substituted with the residue of column 1.

TABLE 7

| Residue | Similar Substitutions |
|---------|----------------------|
| Ala | Ser; Thr; Gly; Val; Leu; Ile |
| Arg | Lys; His; Gly |
| Asn | Gln; His; Gly; Ser; Thr |
| Asp | Glu, Ser; Thr |
| Gln | Asn; Ala |
| Cys | Ser; Gly |
| Glu | Asp |
| Gly | Pro; Arg |
| His | Asn; Gln; Tyr; Phe; Lys; Arg |
| Ile | Ala; Leu; Val; Gly; Met |
| Leu | Ala; Ile; Val; Gly; Met |
| Lys | Arg; His; Gln; Gly; Pro |
| Met | Leu; Ile; Phe |
| Phe | Met; Leu; Tyr; Trp; His; Val; Ala |
| Ser | Thr; Gly; Asp; Ala; Val; Ile; His |
| Thr | Ser; Val; Ala; Gly |
| Trp | Tyr; Phe; His |
| Tyr | Trp; Phe; His |
| Val | Ala; Ile; Leu; Gly; Thr; Ser; Glu |

Substitutions that are less conservative than those in Table 7 can be selected by picking residues that differ more significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. The substitutions which in general are expected to produce the greatest changes in protein properties will be those in which (a) a hydrophilic residue, for example, seryl or threonyl, is substituted for (or by) a hydrophobic residue, for example, leucyl, isoleucyl, phenylalanyl, valyl or alanyl; (b) a cysteine or proline is substituted for (or by) any other residue; (c) a residue having an electropositive side chain, for example, lysyl, arginyl, or histidyl, is substituted for (or by) an electronegative residue, for example, glutamyl or aspartyl; or (d) a residue having a bulky side chain, for example, phenylalanine, is substituted for (or by) one not having a side chain, for example, glycine.

Further Modifying Sequences of the Invention—Mutation/Forced Evolution

In addition to generating silent or conservative substitutions as noted, above, the present invention optionally includes methods of modifying the sequences of the Sequence Listing. In the methods, nucleic acid or protein modification methods are used to alter the given sequences to produce new sequences and/or to chemically or enzymatically modify given sequences to change the properties of the nucleic acids or proteins.

Thus, in one embodiment, given nucleic acid sequences are modified, for example, according to standard mutagenesis or artificial evolution methods to produce modified sequences. The modified sequences may be created using purified natural polynucleotides isolated from any organism or may be synthesized from purified compositions and chemicals using chemical means well known to those of skill in the art. For example, Ausubel, supra, provides additional details on mutagenesis methods. Artificial forced evolution methods are described, for example, by Stemmer (1994) *Nature* 370: 389-391, Stemmer (1994) *Proc. Natl. Acad. Sci.* 91: 10747-10751, and U.S. Pat. Nos. 5,811,238, 5,837,500, and 6,242,568. Methods for engineering synthetic transcription factors and other polypeptides are described, for example, by Zhang et al. (2000) *J. Biol. Chem.* 275: 33850-33860, Liu et al. (2001) *J. Biol. Chem.* 276: 11323-11334, and Isalan et al. (2001) *Nature Biotechnol.* 19:

656-660. Many other mutation and evolution methods are also available and expected to be within the skill of the practitioner.

Similarly, chemical or enzymatic alteration of expressed nucleic acids and polypeptides can be performed by standard methods. For example, sequence can be modified by addition of lipids, sugars, peptides, organic or inorganic compounds, by the inclusion of modified nucleotides or amino acids, or the like. For example, protein modification techniques are illustrated in Ausubel, supra. Further details on chemical and enzymatic modifications can be found herein. These modification methods can be used to modify any given sequence, or to modify any sequence produced by the various mutation and artificial evolution modification methods noted herein.

Accordingly, the invention provides for modification of any given nucleic acid by mutation, evolution, chemical or enzymatic modification, or other available methods, as well as for the products produced by practicing such methods, for example, using the sequences herein as a starting substrate for the various modification approaches.

For example, optimized coding sequence containing codons preferred by a particular prokaryotic or eukaryotic host can be used for example, to increase the rate of translation or to produce recombinant RNA transcripts having desirable properties, such as a longer half-life, as compared with transcripts produced using a non-optimized sequence. Translation stop codons can also be modified to reflect host preference. For example, preferred stop codons for *Saccharomyces cerevisiae* and mammals are TAA and TGA, respectively. The preferred stop codon for monocotyledonous plants is TGA, whereas insects and *E. coli* prefer to use TAA as the stop codon.

The polynucleotide sequences of the present invention can also be engineered in order to alter a coding sequence for a variety of reasons, including but not limited to, alterations which modify the sequence to facilitate cloning, processing and/or expression of the gene product. For example, alterations are optionally introduced using techniques which are well known in the art, for example, site-directed mutagenesis, to insert new restriction sites, to alter glycosylation patterns, to change codon preference, to introduce splice sites, etc.

Furthermore, a fragment or domain derived from any of the polypeptides of the invention can be combined with domains derived from other transcription factors or synthetic domains to modify the biological activity of a transcription factor. For instance, a DNA-binding domain derived from a transcription factor of the invention can be combined with the activation domain of another transcription factor or with a synthetic activation domain. A transcription activation domain assists in initiating transcription from a DNA-binding site. Examples include the transcription activation region of VP16 or GAL4 (Moore et al. (1998) *Proc. Natl. Acad. Sci.* 95: 376-381; Aoyama et al. (1995) *Plant Cell* 7: 1773-1785), peptides derived from bacterial sequences (Ma and Ptashne (1987) *Cell* 51: 113-119) and synthetic peptides (Giniger and Ptashne (1987) *Nature* 330: 670-672).

Expression and Modification of Polypeptides

Typically, polynucleotide sequences of the invention are incorporated into recombinant DNA (or RNA) molecules that direct expression of polypeptides of the invention in appropriate host cells, transgenic plants, in vitro translation systems, or the like. Due to the inherent degeneracy of the genetic code, nucleic acid sequences which encode substantially the same or a functionally equivalent amino acid sequence can be substituted for any listed sequence to provide for cloning and expressing the relevant homolog.

The transgenic plants of the present invention comprising recombinant polynucleotide sequences are generally derived from parental plants, which may themselves be non-transformed (or non-transgenic) plants. These transgenic plants may either have a transcription factor gene "knocked out" (for example, with a genomic insertion by homologous recombination, an antisense or ribozyme construct) or expressed to a normal or wild-type extent. However, overexpressing transgenic "progeny" plants will exhibit greater mRNA levels, wherein the mRNA encodes a transcription factor, that is, a DNA-binding protein that is capable of binding to a DNA regulatory sequence and inducing transcription, and preferably, expression of a plant trait gene. Preferably, the mRNA expression level will be at least three-fold greater than that of the parental plant, or more preferably at least ten-fold greater mRNA levels compared to said parental plant, and most preferably at least fifty-fold greater compared to said parental plant.

Vectors, Promoters, and Expression Systems

The present invention includes recombinant constructs comprising one or more of the nucleic acid sequences herein. The constructs typically comprise a vector, such as a plasmid, a cosmid, a phage, a virus (for example, a plant virus), a bacterial artificial chromosome (BAC), a yeast artificial chromosome (YAC), or the like, into which a nucleic acid sequence of the invention has been inserted, in a forward or reverse orientation. In a preferred aspect of this embodiment, the construct further comprises regulatory sequences, including, for example, a promoter, operably linked to the sequence. Large numbers of suitable vectors and promoters are known to those of skill in the art, and are commercially available.

General texts that describe molecular biological techniques useful herein, including the use and production of vectors, promoters and many other relevant topics, include Berger, Sambrook, supra and Ausubel, supra. Any of the identified sequences can be incorporated into a cassette or vector, for example, for expression in plants. A number of expression vectors suitable for stable transformation of plant cells or for the establishment of transgenic plants have been described including those described in Weissbach and Weissbach (1989) *Methods for Plant Molecular Biology*, Academic Press, and Gelvin et al. (1990) *Plant Molecular Biology Manual*, Kluwer Academic Publishers. Specific examples include those derived from a Ti plasmid of *Agrobacterium tumefaciens*, as well as those disclosed by Herrera-Estrella et al. (1983) *Nature* 303: 209, Bevan (1984) *Nucleic Acids Res.* 12: 8711-8721, Klee (1985) *Bio/Technology* 3: 637-642, for dicotyledonous plants.

Alternatively, non-Ti vectors can be used to transfer the DNA into monocotyledonous plants and cells by using free DNA delivery techniques. Such methods can involve, for example, the use of liposomes, electroporation, microprojectile bombardment, silicon carbide whiskers, and viruses. By using these methods transgenic plants such as wheat, rice (Christou (1991) *Bio/Technology* 9: 957-962) and corn (Gordon-Kamm (1990) *Plant Cell* 2: 603-618) can be produced. An immature embryo can also be a good target tissue for monocots for direct DNA delivery techniques by using the particle gun (Weeks et al. (1993) *Plant Physiol.* 102: 1077-1084; Vasil (1993) *Bio/Technology* 10: 667-674; Wan and Lemeaux (1994) *Plant Physiol.* 104: 37-48, and for *Agrobacterium*-mediated DNA transfer (Ishida et al. (1996) *Nature Biotechnol.* 14: 745-750).

Typically, plant transformation vectors include one or more cloned plant coding sequence (genomic or cDNA) under the transcriptional control of 5' and 3' regulatory sequences and a dominant selectable marker. Such plant transformation vectors typically also contain a promoter (for example, a regulatory region controlling inducible or constitutive, environmentally- or developmentally-regulated, or cell- or tissue-specific expression), a transcription initiation start site, an RNA processing signal (such as intron splice sites), a transcription termination site, and/or a polyadenylation signal.

A potential utility for the transcription factor polynucleotides disclosed herein is the isolation of promoter elements from these genes that can be used to program expression in plants of any genes. Each transcription factor gene disclosed herein is expressed in a unique fashion, as determined by promoter elements located upstream of the start of translation, and additionally within an intron of the transcription factor gene or downstream of the termination codon of the gene. As is well known in the art, for a significant portion of genes, the promoter sequences are located entirely in the region directly upstream of the start of translation. In such cases, typically the promoter sequences are located within 2.0 kb of the start of translation, or within 1.5 kb of the start of translation, frequently within 1.0 kb of the start of translation, and sometimes within 0.5 kb of the start of translation.

The promoter sequences can be isolated according to methods known to one skilled in the art.

Examples of constitutive plant promoters which can be useful for expressing the TF sequence include: the cauliflower mosaic virus (CaMV) 35S promoter, which confers constitutive, high-level expression in most plant tissues (for example, in Odell et al. (1985) *Nature* 313: 810-812); the nopaline synthase promoter (An et al. (1988) *Plant Physiol.* 88: 547-552); and the octopine synthase promoter (Fromm et al. (1989) *Plant Cell* 1: 977-984).

The transcription factors of the invention may be operably linked with a specific promoter that causes the transcription factor to be expressed in response to environmental, tissue-specific or temporal signals. A variety of plant gene promoters that regulate gene expression in response to environmental, hormonal, chemical, developmental signals, and in a tissue-active manner can be used for expression of a TF sequence in plants. Choice of a promoter is based largely on the phenotype of interest and is determined by such factors as tissue (for example, seed, fruit, root, pollen, vascular tissue, flower, carpel, etc.), inducibility (for example, in response to wounding, heat, cold, drought, light, pathogens, etc.), timing, developmental stage, and the like. Numerous known promoters have been characterized and can favorably be employed to promote expression of a polynucleotide of the invention in a transgenic plant or cell of interest. For example, tissue-specific promoters include: seed-specific promoters (such as the napin, phaseolin or DC3 promoter described in U.S. Pat. No. 5,773,697), fruit-specific promoters that are active during fruit ripening (such as the dru 1 promoter (U.S. Pat. No. 5,783,393), or the 2A11 promoter (U.S. Pat. No. 4,943,674) and the tomato polygalacturonase promoter (Bird et al. (1988) *Plant Mol. Biol.* 11: 651-662), root-specific promoters, such as those disclosed in U.S. Pat. Nos. 5,618,988, 5,837,848 and 5,905,186, pollen-active promoters such as PTA29, PTA26 and PTA13 (U.S. Pat. No. 5,792,929), promoters active in vascular tissue (Ringli and Keller (1998) *Plant Mol. Biol.* 37: 977-988), flower-specific (Kaiser et al. (1995) *Plant Mol. Biol.* 28: 231-243), pollen (Baerson et al. (1994) *Plant Mol. Biol.* 26: 1947-1959), carpels (Ohl et al. (1990) *Plant Cell* 2: 837-848), pollen and ovules (Baerson et al. (1993) *Plant Mol. Biol.* 22: 255-267), auxin-inducible promoters (such as that described in van der Kop et al. (1999) *Plant Mol. Biol.* 39: 979-990 or Baumann et al., (1999) *Plant Cell* 11: 323-334), cytokinin-inducible promoter (Guevara-Garcia (1998) *Plant Mol. Biol.* 38: 743-753), promoters responsive to gibberellin (Shi et al. (1998) *Plant Mol. Biol.* 38: 1053-1060, Willmott et al. (1998) *Plant Molec. Biol.* 38: 817-825) and the like. Additional promoters are those that elicit expression in response to heat (Ainley et al. (1993) *Plant Mol. Biol.* 22: 13-23), light (for example, the pea rbcS-3A promoter, Kuhlemeier et al. (1989) *Plant Cell* 1: 471-478), and the maize rbcS promoter, Schaffner and Sheen (1991) *Plant Cell* 3: 997-1012); wounding (for example, wunI, Siebertz et al. (1989) *Plant Cell* 1: 961-968); pathogens (such as the PR-1 promoter described in Buchel et al. (1999) *Plant Mol. Biol.* 40: 387-396, and the PDF1.2 promoter described in Manners et al. (1998) *Plant Mol. Biol.* 38: 1071-1080), and chemicals such as methyl jasmonate or salicylic acid (Gatz (1997) *Annu. Rev. Plant Physiol. Plant Mol. Biol.* 48: 89-108). In addition, the timing of the expression can be controlled by using promoters such as those acting at senescence (Gan and Amasino (1995) *Science* 270: 1986-1988); or late seed development (Odell et al. (1994) *Plant Physiol.* 106: 447-458).

Plant expression vectors can also include RNA processing signals that can be positioned within, upstream or downstream of the coding sequence. In addition, the expression vectors can include additional regulatory sequences from the 3'-untranslated region of plant genes, for example, a 3' terminator region to increase mRNA stability of the mRNA, such as the PI-II terminator region of potato or the octopine or nopaline synthase 3' terminator regions.

Additional Expression Elements

Specific initiation signals can aid in efficient translation of coding sequences. These signals can include, for example, the ATG initiation codon and adjacent sequences. No additional translational control signals may be needed where a coding sequence, its initiation codon and upstream sequences are inserted into the appropriate expression vector. However, in cases where only coding sequence (for example, a mature protein coding sequence) or a portion thereof is inserted, exogenous transcriptional control signals including the ATG initiation codon can be separately provided. The initiation codon is provided in the correct reading frame to facilitate transcription. Exogenous transcriptional elements and initiation codons can be of various origins, both natural and synthetic. The efficiency of expression can be enhanced by the inclusion of enhancers appropriate to the cell system in use.

Expression Hosts

The present invention also relates to host cells which are transduced with vectors of the invention, and the production of polypeptides of the invention (including fragments thereof) by recombinant techniques. Host cells are genetically engineered (i.e., nucleic acids are introduced, for example, transduced, transformed or transfected) with the vectors of this invention, which may be, for example, a cloning vector or an expression vector comprising the relevant nucleic acids herein. The vector is optionally a plasmid, a viral particle, a phage, a naked nucleic acid, etc. The engineered host cells can be cultured in conventional nutrient media modified as appropriate for activating promoters, selecting transformants, or amplifying the relevant gene. The culture conditions, such as temperature, pH and the like, are those previously used with the host cell selected for expression, and will be apparent to those skilled in the art and in the references cited herein, including, Sambrook, supra and Ausubel, supra.

The host cell can be a eukaryotic cell, such as a yeast cell, or a plant cell, or the host cell can be a prokaryotic cell, such as a bacterial cell. Plant protoplasts are also suitable for some applications. For example, the DNA fragments are introduced into plant tissues, cultured plant cells or plant protoplasts by standard methods including electroporation (Fromm et al. (1985) *Proc. Natl. Acad. Sci.* 82: 5824-5828), infection by viral vectors such as cauliflower mosaic virus (CaMV) (Hohn et al. (1982) *Molecular Biology of Plant Tumors* Academic Press, New York, N.Y., pp. 549-560; U.S. Pat. No. 4,407,956), high velocity ballistic penetration by small particles with the nucleic acid either within the matrix of small beads or particles, or on the surface (Klein et al. (1987) *Nature* 327: 70-73), use of pollen as vector (WO 85/01856), or use of *Agrobacterium tumefaciens* or *A. rhizogenes* carrying a T-DNA plasmid in which DNA fragments are cloned. The T-DNA plasmid is transmitted to plant cells upon infection by *Agrobacterium tumefaciens*, and a portion is stably integrated into the plant genome (Horsch et al. (1984) *Science* 233: 496-498; Fraley et al. (1983) *Proc. Natl. Acad. Sci.* 80: 4803-4807).

The cell can include a nucleic acid of the invention that encodes a polypeptide, wherein the cell expresses a polypeptide of the invention. The cell can also include vector sequences, or the like. Furthermore, cells and transgenic plants that include any polypeptide or nucleic acid above or throughout this specification, for example, produced by transduction of a vector of the invention, are an additional feature of the invention.

For long-term, high-yield production of recombinant proteins, stable expression can be used. Host cells transformed with a nucleotide sequence encoding a polypeptide of the invention are optionally cultured under conditions suitable for the expression and recovery of the encoded protein from cell culture. The protein or fragment thereof produced by a recombinant cell may be secreted, membrane-bound, or contained intracellularly, depending on the sequence and/or the vector used. As will be understood by those of skill in the art, expression vectors containing polynucleotides encoding mature proteins of the invention can be designed with signal sequences which direct secretion of the mature polypeptides through a prokaryotic or eukaryotic cell membrane.

Modified Amino Acid Residues

Polypeptides of the invention may contain one or more modified amino acid residues. The presence of modified amino acids may be advantageous in, for example, increasing polypeptide half-life, reducing polypeptide antigenicity or toxicity, increasing polypeptide storage stability, or the like. Amino acid residue(s) are modified, for example, co-translationally or post-translationally during recombinant production or modified by synthetic or chemical means.

Non-limiting examples of a modified amino acid residue include incorporation or other use of acetylated amino acids, glycosylated amino acids, sulfated amino acids, prenylated (for example, farnesylated, geranylgeranylated) amino acids, PEG modified (for example, "PEGylated") amino acids, biotinylated amino acids, carboxylated amino acids, phosphorylated amino acids, etc. References adequate to guide one of skill in the modification of amino acid residues are replete throughout the literature.

The modified amino acid residues may prevent or increase affinity of the polypeptide for another molecule, including, but not limited to, polynucleotide, proteins, carbohydrates, lipids and lipid derivatives, and other organic or synthetic compounds.

Identification of Additional Protein Factors

A transcription factor provided by the present invention can also be used to identify additional endogenous or exogenous molecules that can affect a phenotype or trait of interest. Such molecules include endogenous molecules that are acted upon either at a transcriptional level by a transcription factor of the invention to modify a phenotype as desired. For example, the transcription factors can be employed to identify one or more downstream genes that are subject to a regulatory effect of the transcription factor. In one approach, a transcription factor or transcription factor homolog of the invention is expressed in a host cell, for example, a transgenic plant cell, tissue or explant, and expression products, either RNA or protein, of likely or random targets are monitored, for example, by hybridization to a microarray of nucleic acid probes corresponding to genes expressed in a tissue or cell type of interest, by two-dimensional gel electrophoresis of protein products, or by any other method known in the art for assessing expression of gene products at the level of RNA or protein. Alternatively, a transcription factor of the invention can be used to identify promoter sequences (such as binding sites on DNA sequences) involved in the regulation of a downstream target. After identifying a promoter sequence, interactions between the transcription factor and the promoter sequence can be modified by changing specific nucleotides in the promoter sequence or specific amino acids in the transcription factor that interact with the promoter sequence to alter a plant trait. Typically, transcription factor DNA-binding sites are identified by gel shift assays. After identifying the promoter regions, the promoter region sequences can be employed in double-stranded DNA arrays to identify molecules that affect the interactions of the transcription factors with their promoters (Bulyk et al. (1999) *Nature Biotechnol.* 17: 573-577).

The identified transcription factors are also useful to identify proteins that modify the activity of the transcription factor. Such modification can occur by covalent modification, such as by phosphorylation, or by protein-protein (homo or -heteropolymer) interactions. Any method suitable for detecting protein-protein interactions can be employed. Among the methods that can be employed are co-immunoprecipitation, cross-linking and co-purification through gradients or chromatographic columns, and the two-hybrid yeast system.

The two-hybrid system detects protein interactions in vivo and is described in Chien et al. ((1991) *Proc. Natl. Acad. Sci.* 88: 9578-9582) and is commercially available from Clontech (Palo Alto, Calif.). In such a system, plasmids are constructed that encode two hybrid proteins: one consists of the DNA-binding domain of a transcription activator protein fused to the TF polypeptide and the other consists of the transcription activator protein's activation domain fused to an unknown protein that is encoded by a cDNA that has been recombined into the plasmid as part of a cDNA library. The DNA-binding domain fusion plasmid and the cDNA library are transformed into a strain of the yeast *Saccharomyces cerevisiae* that contains a reporter gene (for example, lacZ) whose regulatory region contains the transcription activator's binding site. Either hybrid protein alone cannot activate transcription of the reporter gene. Interaction of the two hybrid proteins reconstitutes the functional activator protein and results in expression of the reporter gene, which is detected by an assay for the reporter gene product. Then, the library plasmids responsible for reporter gene expression are isolated and sequenced to identify the proteins encoded by the library plasmids. After identifying proteins that interact with the transcription factors, assays for compounds that interfere with the TF protein-protein interactions can be performed.

Subsequences

Also contemplated are uses of polynucleotides, also referred to herein as oligonucleotides, typically having at least 12 or more bases that h hybridize under stringent or highly stringent conditions to a polynucleotide sequence described above. The polynucleotides may be used as probes, primers, sense and antisense agents, and the like, according to methods as noted above.

Subsequences of the polynucleotides of the invention, including polynucleotide fragments and oligonucleotides are useful as nucleic acid probes and primers. An oligonucleotide suitable for use as a probe or primer is at least about 15 nucleotides in length, more often at least about 18 nucleotides, often at least about 21 nucleotides, frequently at least about 30 nucleotides, or about 40 nucleotides, or more in length. A nucleic acid probe is useful in hybridization protocols, for example, to identify additional polypeptide homologs of the invention, including protocols for microarray experiments. Primers can be annealed to a complementary target DNA strand by nucleic acid hybridization to form a hybrid between the primer and the target DNA strand, and then extended along the target DNA strand by a DNA polymerase enzyme. Primer pairs can be used for amplification of a nucleic acid sequence, for example, by the polymerase chain reaction (PCR) or other nucleic-acid amplification methods (Sambrook, supra, and Ausubel, supra).

In addition, the invention includes an isolated or recombinant polypeptide including a subsequence of at least about 15 contiguous amino acids encoded by the recombinant or isolated polynucleotides of the invention. For example, such polypeptides, or domains or fragments thereof, can be used as immunogens, for example, to produce antibodies specific for the polypeptide sequence, or as probes for detecting a sequence of interest. A subsequence can range in size from about 15 amino acids in length up to and including the full length of the polypeptide.

To be encompassed by the present invention, an expressed polypeptide which comprises such a polypeptide subsequence performs at least one biological function of the intact polypeptide in substantially the same manner, or to a similar extent, as does the intact polypeptide. For example, a polypeptide fragment can comprise a recognizable structural motif or functional domain such as a DNA binding domain that activates transcription, for example, by binding to a specific DNA promoter region an activation domain, or a domain for protein-protein interactions.

Production of Transgenic Plants and Modification of Traits.

The polynucleotides of the invention are favorably employed to produce transgenic plants with various traits or characteristics that have been modified in a desirable manner, for example, to improve the seed characteristics of a plant. For example, alteration of expression levels or patterns (for example, spatial or temporal expression patterns) of one or more of the transcription factors (or transcription factor homologs) of the invention, as compared with the levels of the same protein found in a wild-type plant, can be used to modify a plant's traits. An illustrative example of trait modification, improved characteristics, by altering expression levels of a particular transcription factor is described further in the Examples and the Sequence Listing.

Arabidopsis as a Model System.

Arabidopsis thaliana is the object of rapidly growing attention as a model for genetics and metabolism in plants. Arabidopsis has a small genome, and well-documented studies are available. It is easy to grow in large numbers and mutants defining important genetically controlled mechanisms are either available, or can readily be obtained. Various methods to introduce and express isolated homologous genes are available (Koncz et al., eds., Methods in Arabidopsis Research (1992) World Scientific, New Jersey, N.J., in "Preface"). Because of its small size, short life cycle, obligate autogamy and high fertility, Arabidopsis is also a choice organism for the isolation of mutants and studies in morphogenetic and development pathways, and control of these pathways by transcription factors (Koncz (1992) supra, p. 72). A number of studies introducing transcription factors into A. thaliana have demonstrated the utility of this plant for understanding the mechanisms of gene regulation and trait alteration in plants (for example, in Koncz (1992) supra, and in U.S. Pat. No. 6,417,428).

Arabidopsis Genes in Transgenic Plants.

Expression of genes which encode transcription factors modify expression of endogenous genes, polynucleotides, and proteins are well known in the art. In addition, transgenic plants comprising isolated polynucleotides encoding transcription factors may also modify expression of endogenous genes, polynucleotides, and proteins. Examples include Peng et al. (1997) Genes and Development 11: 3194-3205 and Peng et al. (1999) Nature 400: 256-261. In addition, many others have demonstrated that an Arabidopsis transcription factor expressed in an exogenous plant species elicits the same or very similar phenotypic response (Fu et al. (2001) Plant Cell 13: 1791-1802; Nandi et al. (2000) Curr. Biol. 10: 215-218; Coupland (1995) Nature 377: 482-483; and Weigel and Nilsson (1995) Nature 377: 482-500.

Homologous Genes Introduced into Transgenic Plants.

Homologous genes that may be derived from any plant, or from any source whether natural, synthetic, semi-synthetic or recombinant, and that share significant sequence identity or similarity to those provided by the present invention, may be introduced into plants, for example, crop plants, to confer desirable or improved traits. Consequently, transgenic plants may be produced that comprise a recombinant expression vector or cassette with a promoter operably linked to one or more sequences homologous to presently disclosed sequences. The promoter may be, for example, a plant or viral promoter.

The invention thus provides for methods for preparing transgenic plants, and for modifying plant traits. These methods include introducing into a plant a recombinant expression vector or cassette comprising a functional promoter operably linked to one or more sequences homologous to presently disclosed sequences. Plants and kits for producing these plants that result from the application of these methods are also encompassed by the present invention.

Transcription Factors of Interest for the Modification of Plant Traits.

Currently, the existence of a series of maturity groups for different latitudes represents a major barrier to the introduction of new valuable traits. Any trait (for example disease resistance) has to be bred into each of the different maturity groups separately, a laborious and costly exercise. The availability of single strain, which could be grown at any latitude, would therefore greatly increase the potential for introducing new traits to crop species such as soybean and cotton.

For the specific effects, traits and utilities conferred to plants, one or more transcription factor genes of the present invention may be used to increase or decrease, or improve or prove deleterious to a given trait. For example, knocking out a transcription factor gene that naturally occurs in a plant, or suppressing the gene (with, for example, antisense suppression), may cause decreased tolerance to shade or a drought stress relative to non-transformed or wild-type plants. By overexpressing this gene, the plant may experience increased tolerance to the same stress. More than one transcription factor gene may be introduced into a plant, either by transforming the plant with one or more vectors comprising two or more transcription factors, or by selective breeding of plants to yield hybrid crosses that comprise more than one introduced transcription factor.

Genes, Traits and Utilities that Affect Plant Characteristics.

Plant transcription factors can modulate gene expression, and, in turn, be modulated by the environmental experience of a plant. Significant alterations in a plant's environment invariably result in a change in the plant's transcription factor gene expression pattern. Altered transcription factor expression patterns generally result in phenotypic changes in the plant. Transcription factor gene product(s) in transgenic plants then differ(s) in amounts or proportions from that found in wild-type or non-transformed plants, and those transcription factors likely represent polypeptides that are used to alter the response to the environmental change. By way of example, it is well accepted in the art that analytical methods based on altered expression patterns may be used to screen for phenotypic changes in a plant far more effectively than can be achieved using traditional methods.

Potential Applications of Presently Disclosed Sequences that Regulate Abiotic Stress Tolerance Sugar Sensing.

In addition to their important role as an energy source and structural component of the plant cell, sugars are central regulatory molecules that control several aspects of plant physiology, metabolism and development (Hsieh et al. (1998) *Proc. Natl. Acad. Sci.* 95: 13965-13970). It is thought that this control is achieved by regulating gene expression and, in higher plants, sugars have been shown to repress or activate plant genes involved in many essential processes such as photosynthesis, glyoxylate metabolism, respiration, starch and sucrose synthesis and degradation, pathogen response, wounding response, cell cycle regulation, pigmentation, flowering and senescence. The mechanisms by which sugars control gene expression are not understood.

Several sugar sensing mutants have turned out to be allelic to ABA and ethylene mutants. ABA is found in all photosynthetic organisms and acts as a key regulator of transpiration, stress responses, embryogenesis, and seed germination. Most ABA effects are related to the compound acting as a signal of decreased water availability, whereby it triggers a reduction in water loss, slows growth, and mediates adaptive responses. However, ABA also influences plant growth and development via interactions with other phytohormones. Physiological and molecular studies indicate that maize and *Arabidopsis* have almost identical pathways with regard to ABA biosynthesis and signal transduction (for example, in Finkelstein and Rock (2002) "Abscisic acid biosynthesis and response", in *The Arabidopsis Book*, Somerville and Meyerowitz, editors (American Society of Plant Biologists, Rockville, Md.).

This potentially implicates the sequences of the invention that, when overexpressed, confer a sugar sensing or hormone signaling phenotype in plants. On the other hand, the sucrose treatment used in these experiments (9.4% w/v) could also be an osmotic stress. Therefore, one could interpret these data as an indication that these transgenic lines are more tolerant to osmotic stress. However, it is well known that plant responses to ABA, osmotic and other stress may be linked, and these different treatments may even act in a synergistic manner to increase the degree of a response. For example, Xiong, Ishitani, and Zhu ((1999) *Plant Physiol.* 119: 205-212) have shown that genetic and molecular studies may be used to show extensive interaction between osmotic stress, temperature stress, and ABA responses in plants. These investigators analyzed the expression of RD29A-LUC in response to various treatment regimes in *Arabidopsis*. The RD29A promoter contains both the ABA-responsive and the dehydration-responsive element—also termed the C-repeat—and can be activated by osmotic stress, low temperature, or ABA treatment; transcription of the RD29A gene in response to osmotic and cold stresses is mediated by both ABA-dependent and ABA-independent pathways (Xiong, Ishitani, and Zhu (1999) supra). LUC refers to the firefly luciferase coding sequence, which, in this case, was driven by the stress responsive RD29A promoter. The results revealed both positive and negative interactions, depending on the nature and duration of the treatments. Low temperature stress was found to impair osmotic signaling but moderate heat stress strongly enhanced osmotic stress induction, thus acting synergistically with osmotic signaling pathways. In this study, the authors reported that osmotic stress and ABA can act synergistically by showing that the treatments simultaneously induced transgene and endogenous gene expression. Similar results were reported by Bostock and Quatrano ((1992) *Plant Physiol.* 98: 1356-1363), who found that osmotic stress and ABA act synergistically and induce maize Em gene expression. Ishitani et al (1997) *Plant Cell* 9: 1935-1949) isolated a group of *Arabidopsis* single-gene mutations that confer enhanced responses to both osmotic stress and ABA. The nature of the recovery of these mutants from osmotic stress and ABA treatment suggested that although separate signaling pathways exist for osmotic stress and ABA, the pathways share a number of components; these common components may mediate synergistic interactions between osmotic stress and ABA. Thus, contrary to the previously-held belief that ABA-dependent and ABA-independent stress signaling pathways act in a parallel manner, our data reveal that these pathways cross-talk and converge to activate stress gene expression.

Because sugars are important signaling molecules, the ability to control either the concentration of a signaling sugar or how the plant perceives or responds to a signaling sugar could be used to control plant development, physiology or metabolism. For example, the flux of sucrose (a disaccharide sugar used for systemically transporting carbon and energy in most plants) has been shown to affect gene expression and alter storage compound accumulation in seeds. Manipulation of the sucrose signaling pathway in seeds may therefore cause seeds to have more protein, oil or carbohydrate, depending on the type of manipulation. Similarly, in tubers, sucrose is converted to starch which is used as an energy store. It is thought that sugar signaling pathways may partially determine the levels of starch synthesized in the tubers. The manipulation of sugar signaling in tubers could lead to tubers with a higher starch content.

Thus, altering the expression of the presently disclosed transcription factor genes that manipulate the sugar signal transduction pathway, including, for example, G175, G303, G354, G481, G916, G922, G1069, G1073, G1820, G2053, G2701, G2789, G2839, G2854, along with their equivalogs, or that exhibit an osmotic stress phenotype, including, for example, G47, G482, G489 or G1069, G1073, as evidenced by their tolerance to, for example, high mannitol, salt or PEG, may be used to produce plants with desirable traits, including increased drought tolerance. In particular, manipulation of sugar signal transduction pathways could be used to alter source-sink relationships in seeds, tubers, roots and other storage organs leading to increase in yield.

Abiotic Stress: Drought and Low Humidity Tolerance.

Exposure to dehydration invokes similar survival strategies in plants as does freezing stress (for example, in Yelenosky (1989) *Plant Physiol* 89: 444-451) and drought stress induces freezing tolerance (for example, in Siminovitch et al. (1982) *Plant Physiol* 69: 250-255; and Guy et al. (1992) *Planta* 188: 265-270). In addition to the induction of cold-acclimation proteins, strategies that allow plants to survive in low water conditions may include, for example, reduced surface area, or surface oil or wax production. Modifying the expression of the presently disclosed transcription factor genes, including G2133, G1274, G922, G2999, G3086, G354, G1792, G2053, G975, G1069, G916, G1820, G2701, G47, G2854, G2789, G634, G175, G2839, G1452, G3083, G489, G303, G2992, and G682, and their equivalogs, may be used to increase a plant's tolerance to low water conditions and provide the benefits of improved survival, increased yield and an extended geographic and temporal planting range.

Osmotic Stress.

Modification of the expression of a number of presently disclosed transcription factor genes, for example, G47, G482, G489 or G1069, G2053 and their equivalogs, may be used to increase germination rate or growth under adverse osmotic conditions, which could impact survival and yield of seeds and plants. Osmotic stresses may be regulated by specific molecular control mechanisms that include genes controlling water and ion movements, functional and structural stress-induced proteins, signal perception and transduction, and free radical scavenging, and many others (Wang et al. (2001) *Acta Hort*. (ISHS) 560: 285-292). Instigators of osmotic stress include freezing, drought and high salinity, each of which are discussed in more detail below.

In many ways, freezing, high salt and drought have similar effects on plants, not the least of which is the induction of common polypeptides that respond to these different stresses. For example, freezing is similar to water deficit in that freezing reduces the amount of water available to a plant. Exposure to freezing temperatures may lead to cellular dehydration as water leaves cells and forms ice crystals in intercellular spaces (Buchanan et al. (2000) in *Biochemistry and Molecular Biology of Plants*, American Society of Plant Physiologists, Rockville, Md.). As with high salt concentration and freezing, the problems for plants caused by low water availability include mechanical stresses caused by the withdrawal of cellular water. Thus, the incorporation of transcription factors that modify a plant's response to osmotic stress into, for example, a crop or ornamental plant, may be useful in reducing damage or loss. Specific effects caused by freezing, high salt and drought are addressed below.

The Relationship Between Salt, Drought and Freezing Tolerance.

Plants are subject to a range of environmental challenges. Several of these, including drought stress, have the ability to impact whole plant and cellular water availability. Not surprisingly, then, plant responses to this collection of stresses are related. In a recent review, Zhu notes that "most studies on water stress signaling have focused on salt stress primarily because plant responses to salt and drought are closely related and the mechanisms overlap" (Zhu (2002) *Ann. Rev. Plant Biol.* 53: 247-273). Many examples of similar responses and pathways to this set of stresses have been documented. For example, the CBF transcription factors have been shown to condition resistance to salt, freezing and drought (Kasuga et al. (1999) *Nature Biotech.* 17: 287-291). The *Arabidopsis* rd29B gene is induced in response to both salt and dehydration stress, a process that is mediated largely through an ABA signal transduction process (Uno et al. (2000) *Proc. Natl. Acad. Sci.* USA 97: 11632-11637), resulting in altered activity of transcription factors that bind to an upstream element within the rd29B promoter. In *Mesembryanthemum crystallinum* (ice plant), Patharker and Cushman have shown that a calcium-dependent protein kinase (McCDPK1) is induced by exposure to both drought and salt stresses (Patharker and Cushman (2000) *Plant J.* 24: 679-691). The stress-induced kinase was also shown to phosphorylate a transcription factor, presumably altering its activity, although transcript levels of the target transcription factor are not altered in response to salt or drought stress. Similarly, Saijo et al. demonstrated that a rice salt/drought-induced calmodulin-dependent protein kinase (OsCDPK7) conferred increased salt and drought tolerance to rice when overexpressed (Saijo et al. (2000) *Plant J.* 23: 319-327).

Exposure to dehydration invokes similar survival strategies in plants as does freezing stress (for example, in Yelenosky (1989) *Plant Physiol* 89: 444-451) and drought stress induces freezing tolerance (for example, in Siminovitch et al. (1982) *Plant Physiol* 69: 250-255; and Guy et al. (1992) *Planta* 188: 265-270). In addition to the induction of cold-acclimation proteins, strategies that allow plants to survive in low water conditions may include, for example, reduced surface area, or surface oil or wax production.

Consequently, one skilled in the art would expect that some pathways involved in resistance to one of these stresses, and hence regulated by an individual transcription factor, will also be involved in resistance to another of these stresses, regulated by the same or homologous transcription factors. Of course, the overall resistance pathways are related, not identical, and therefore not all transcription factors controlling resistance to one stress will control resistance to the other stresses. Nonetheless, if a transcription factor conditions resistance to one of these stresses, it would be apparent to one skilled in the art to test for resistance to these related stresses.

Thus, the genes of the sequence listing, including, for example, G175, G922, G1452, G1820, G2701, G2999, G3086 and their equivalogs that provide tolerance to salt may be used to engineer salt tolerant crops and trees that can flourish in soils with high saline content or under drought conditions. In particular, increased salt tolerance during the germination stage of a plant enhances survival and yield. Presently disclosed transcription factor genes that provide increased salt tolerance during germination, the seedling stage, and throughout a plant's life cycle, would find particular value for imparting survival and yield in areas where a particular crop would not normally prosper.

Summary of Altered Drought-Related Plant Characteristics.

The clades of structurally and functionally related sequences that derive from a wide range of plants, including polynucleotides of the Sequence Listing and their encoded polypeptides, fragments thereof, paralogs, orthologs, equivalogs, and fragments thereof, is provided. These sequences have been shown in laboratory and field experiments to confer altered size and abiotic stress tolerance phenotypes in plants. The invention also provides the polypeptides of the Sequence Listing, and fragments thereof, conserved domains thereof, paralogs, orthologs, equivalogs, and fragments thereof. Plants that overexpress these sequences have been observed to exhibit a sugar sensing phenotype and/or be more tolerant to a wide variety of abiotic stresses, including drought and high salt stress. Many of the orthologs of these sequences are listed in the Sequence Listing, and due to the high degree of structural similarity to the sequences of the invention, it is expected that these sequences will also function to increase drought stress tolerance. The invention also encompasses the complements of the polynucleotides. The polynucleotides are useful for screening libraries of molecules or compounds for specific binding and for creating transgenic plants having increased drought stress tolerance.

Potential Applications of Polynucleotides and Polypeptides that Regulate C/N Sensing.

The genes identified by the experiments detailed in this report represent potential regulators of plant responses to low nutrient conditions. As such, these genes (or their putative orthologs and paralogs) could be applied to commercial species in order to improve yield, improve performance under conditions of nutrient limitation, and substantially reduce the necessity for fertilizer application.

The data of Lam et al. (Lam (2003) *Plant Physiol.* 132: 926-935) suggest that quantitative changes in seed nitrogen reserves may require enhanced transportation of nitrogen resources. These data further suggest that the C/N sensing screen detailed in the below Examples can provide leads which, based on low anthocyanin accumulation, could be used to create transgenic plants with enhanced seed nitrogen reserves.

The experiments performed with specific sequences and transgenic plants, described in Example IX (below), also identified genes which produced elevated levels of anthocyanin, relative to controls, when lines were tested in the C/N assay. In a number of instances, such an effect was not alleviated by the provision of an organic nitrogen source such as glutamine, suggesting that the genes were producing a non-specific increase in anthocyanin levels. Although such results might not be related to nutrient limitation they likely reveal genes that have important roles in the production of or accumulation of secondary metabolites related to the phenylpropanoid pathway. A variety of applications can be envisaged for such regulatory genes. Uses include altering pigment production for horticultural purposes and increasing stress resistance. For example, flavonoids have antimicrobial activity and could be used to engineer pathogen resistance. In addition, several flavonoid compounds have health promoting effects such as the inhibition of tumor growth, prevention of bone loss and the prevention of the oxidation of lipids. Since the phenylpropanoid biosynthetic pathway feeds into the pathways for the production of a number of other classes of secondary metabolites, such as lignins and tannins, changing the activity of these genes or their paralogs/orthologs might also influence the levels of those types of compounds. For example, increased levels of condensed tannins in forage legumes can prevent pasture bloat in cattle by collapsing protein foams within the rumen. Additionally, lignins are of major interest to the forestry and pulp and paper industries. Elevated levels of lignin increase the quality of wood used for furniture and building materials. However, paper manufacturers desire reduced lignin levels, since these compounds are costly to remove during the pulping process.

Both light and the C/N metabolic status of the plant tightly regulate the uptake, assimilation, and transport of nitrogen from sources (e.g. leaves) to sinks (e.g. developing seeds). We used an assay that has been developed to detect alterations in the mechanisms that plants use to sense internal levels of carbon and nitrogen metabolites and presumably activate signal transduction cascades which regulate the transcription of N-assimilatory genes (Hsieh et al. (1998) *Proc. Natl. Acad. Sci.* 95: 13965-13970). To determine whether the mechanisms used to sense nitrogen status are altered in a particular mutant or transgenic line, we exploited the observation that seedlings of wild-type plants accumulate high levels of anthocyanins when the C/N balance is disturbed. This was achieved by germinating these plants on media containing high levels of sucrose (3%) without a nitrogen source. Sucrose-induced anthocyanin accumulation may be relieved by the addition of either inorganic or organic nitrogen. Thus, media containing glutamine as a nitrogen source was also used in C/N sensing assays since glutamine also serves as a compound used to transport N in plants.

The clades of sequences shown in laboratory experiments to confer altered C/N sensing in plants, and structurally and functionally related sequences that derive from a wide range of plants, including the polynucleotides and polypeptides of the invention (for example, SEQ ID NO: 234, 286, 312, 324, 420, 422, 424, 294, 426, 428, 430, 432, 434, 436, 438, 240, 440, 442, 444, 446, 448, 450, 452, 454, 456, 458, 460, 462, 248, 464, 466, 468, 470, 472, 474, 476, 478, 482, 484, 486, 488, 490, 492, 494, 496, 498, 500, 502, 504, 506, 508, 510, 512, 514, 516, 518, 520, 522, 238, 524, 526, 528, 530, 532, 534, 536, 538, 540, 542, 544, 546, 548, 550, 10, 552, 12, 554, 556, 558, 560, 562, 564, 566, and 568), polypeptides that are encoded by the polynucleotides of the invention, functional fragments thereof, paralogs, orthologs, equivalogs, and conserved domains thereof are provided. Many of the orthologs of these sequences are listed in the Sequence Listing, and due to the high degree of structural similarity to the sequences of the invention, it is expected that these sequences may also function to modify C/N sensing. The invention also encompasses the complements of the polynucleotides. The polynucleotides are useful for screening libraries of molecules or compounds for specific binding and for creating transgenic plants having altered C/N sensing.

Potential Applications of the Presently Disclosed Sequences that Regulate Shade Tolerance.

The genes identified by the experiment presently disclosed represent potential regulators of plant responses to shade conditions. As such, these genes (or their orthologs and paralogs) could be applied to commercial species in order to improve yield, and potentially allow certain crops to be grown at higher density.

While a shade avoidance phenotype has obvious advantages for plants competing to survive in the wild, in a crop of identical plants to be harvested at the end of the season, it can be a waste of energy and detract resources from storage organs, the accumulation of biomass, and the production of fruits and seeds. Importantly, many plant species initiate a response to shade, due to reflected far-red light from neighbors, well before light availability becomes a growth-limiting factor. These effects have a negative impact on yield, and result in increased volumes of waste by-products, such as straw. In order to compensate for the inefficiencies produced by shading responses, increased fertilizer applications are required to maintain yield. Thus, genes that suppress innate plant shading responses will offer the additional advantages of permitting a reduction in fertilizer usage and a reduction in undesirable waste products.

It should be noted that the transcription factor leads revealed in this study likely represent key components of light response pathways and as such might be used to manipulate additional aspects of plant development and physiology. For example, light response regulators might be applied to manipulate the timing of major growth transitions like the onset of flowering. It should also be recognized that a number of the genes identified, result in generally compact plant morphologies, and as such could be used to produce dwarf varieties that might be attractive for both grain crops or for ornamental species.

Antisense and Co-Suppression

In addition to expression of the nucleic acids of the invention as gene replacement or plant phenotype modification nucleic acids, the nucleic acids are also useful for sense and anti-sense suppression of expression, for example, to down-regulate expression of a nucleic acid of the invention. That is, the nucleic acids of the invention, or subsequences or anti-sense sequences thereof, can be used to block expression of naturally occurring homologous nucleic acids. A variety of sense and anti-sense technologies are known in the art, for example, as set forth in Lichtenstein and Nellen (1997) *Antisense Technology: A Practical Approach*, IRL Press at Oxford University Press, Oxford, U.K. Antisense regulation is also described in Crowley et al. (1985) *Cell* 43: 633-641; Rosenberg et al. (1985) *Nature* 313: 703-706; Preiss et al. (1985) *Nature* 313: 27-32; Melton (1985) *Proc. Natl. Acad. Sci.* 82: 144-148; Izant and Weintraub (1985) *Science* 229: 345-352; and Kim and Wold (1985) *Cell* 42: 129-138. Additional methods for antisense regulation are known in the art. Antisense regulation has been used to reduce or inhibit expression of plant genes in, for example in European Patent Publication No. 271988. Antisense RNA may be used to reduce gene expression to produce a visible or biochemical phenotypic change in a plant (Smith et al. (1988) *Nature*, 334: 724-726; Smith et al. (1990) *Plant Mol. Biol.* 14: 369-379). In general, sense or anti-sense sequences are introduced into a cell, where they are optionally amplified, for example, by transcription. Such sequences include both simple oligonucleotide sequences and catalytic sequences such as ribozymes.

For example, a reduction or elimination of expression (i.e., a "knock-out") of a transcription factor or transcription factor homolog polypeptide in a transgenic plant, for example, to modify a plant trait, can be obtained by introducing an antisense construct corresponding to the polypeptide of interest as a cDNA. For antisense suppression, the transcription factor or homolog cDNA is arranged in reverse orientation (with respect to the coding sequence) relative to the promoter sequence in the expression vector. The introduced sequence need not be the full length cDNA or gene, and need not be identical to the cDNA or gene found in the plant type to be transformed. Typically, the antisense sequence need only be capable of hybridizing to the target gene or RNA of interest. Thus, where the introduced sequence is of shorter length, a higher degree of homology to the endogenous transcription factor sequence will be needed for effective antisense suppression. While antisense sequences of various lengths can be utilized, preferably, the introduced antisense sequence in the vector will be at least 30 nucleotides in length, and improved antisense suppression will typically be observed as the length of the antisense sequence increases. Preferably, the length of the antisense sequence in the vector will be greater than 100 nucleotides. Transcription of an antisense construct as described results in the production of RNA molecules that are the reverse complement of mRNA molecules transcribed from the endogenous transcription factor gene in the plant cell.

Suppression of endogenous transcription factor gene expression can also be achieved using RNA interference, or RNAi. RNAi is a post-transcriptional, targeted gene-silencing technique that uses double-stranded RNA (dsRNA) to incite degradation of messenger RNA (mRNA) containing the same sequence as the dsRNA (Constans, (2002) *The Scientist* 16:36). Small interfering RNAs, or siRNAs are produced in at least two steps: an endogenous ribonuclease cleaves longer dsRNA into shorter, 21-23 nucleotide-long RNAs. The siRNA segments then mediate the degradation of the target mRNA (Zamore, (2001) *Nature Struct. Biol.*, 8:746-50). RNAi has been used for gene function determination in a manner similar to antisense oligonucleotides (Constans, (2002) *The Scientist* 16:36). Expression vectors that continually express siRNAs in transiently and stably transfected cells have been engineered to express small hairpin RNAs (shRNAs), which get processed in vivo into siRNAs-like molecules capable of carrying out gene-specific silencing (Brummelkamp et al., (2002) *Science* 296: 550-553, and Paddison, et al. (2002) *Genes & Dev.* 16:948-958). Post-transcriptional gene silencing by double-stranded RNA is discussed in further detail by Hammond et al. (2001) *Nature Rev Gen* 2: 110-119, Fire et al. (1998) *Nature* 391: 806-811 and Timmons and Fire (1998) *Nature* 395: 854. Vectors in which RNA encoded by a transcription factor or transcription factor homolog cDNA is over-expressed can also be used to obtain co-suppression of a corresponding endogenous gene, for example, in the manner described in U.S. Pat. No. 5,231,020 by Jorgensen. Such co-suppression (also termed sense suppression) does not require that the entire transcription factor cDNA be introduced into the plant cells, nor does it require that the introduced sequence be exactly identical to the endogenous transcription factor gene of interest. However, as with antisense suppression, the suppressive efficiency will be enhanced as specificity of hybridization is increased, for example, as the introduced sequence is lengthened, and/or as the sequence similarity between the introduced sequence and the endogenous transcription factor gene is increased.

Vectors expressing an untranslatable form of the transcription factor mRNA (for example, sequences comprising one or more stop codon or nonsense mutation) can also be used to suppress expression of an endogenous transcription factor, thereby reducing or eliminating its activity and modifying one or more traits. Methods for producing such constructs are described in U.S. Pat. No. 5,583,021. Preferably, such constructs are made by introducing a premature stop codon into the transcription factor gene. Alternatively, a plant trait can be modified by gene silencing using double-strand RNA (Sharp (1999) *Genes and Development* 13: 139-141). Another method for abolishing the expression of a gene is by insertion mutagenesis using the T-DNA of *Agrobacterium tumefaciens*. After generating the insertion mutants, the mutants can be screened to identify those containing the insertion in a transcription factor or transcription factor homolog gene. Plants containing a single transgene insertion event at the desired gene can be crossed to generate homozygous plants for the mutation. Such methods are well known to those of skill in the art (for example, in Koncz et al. (1992) *Methods in Arabidopsis Research*, World Scientific Publishing Co. Pte. Ltd., River Edge, N.J.).

Alternatively, a plant phenotype can be altered by eliminating an endogenous gene, such as a transcription factor or transcription factor homolog, for example, by homologous recombination (Kempin et al. (1997) *Nature* 389: 802-803).

A plant trait can also be modified by using the Cre-lox system (for example, as described in U.S. Pat. No. 5,658,772). A plant genome can be modified to include first and second lox sites that are then contacted with a Cre recombinase. If the lox sites are in the same orientation, the intervening DNA sequence between the two sites is excised. If the lox sites are in the opposite orientation, the intervening sequence is inverted.

The polynucleotides and polypeptides of this invention can also be expressed in a plant in the absence of an expression cassette by manipulating the activity or expression level of the endogenous gene by other means, such as, for example, by ectopically expressing a gene by T-DNA activation tagging (Ichikawa et al. (1997) *Nature* 390 698-701; Kakimoto et al. (1996) *Science* 274: 982-985). This method entails transforming a plant with a gene tag containing multiple transcriptional enhancers and once the tag has inserted into the genome, expression of a flanking gene coding sequence becomes deregulated. In another example, the transcriptional machinery in a plant can be modified so as to increase transcription levels of a polynucleotide of the invention (for example, in PCT Publications WO 96/06166 and WO 98/53057, which describe the modification of the DNA-binding specificity of zinc finger proteins by changing particular amino acids in the DNA-binding motif).

The transgenic plant can also include the machinery necessary for expressing or altering the activity of a polypeptide encoded by an endogenous gene, for example, by altering the phosphorylation state of the polypeptide to maintain it in an activated state.

Transgenic plants (or plant cells, or plant explants, or plant tissues) incorporating the polynucleotides of the invention and/or expressing the polypeptides of the invention can be produced by a variety of well established techniques as described above. Following construction of a vector, most typically an expression cassette, including a polynucleotide, for example, encoding a transcription factor or transcription factor homolog, of the invention, standard techniques can be used to introduce the polynucleotide into a plant, a plant cell, a plant explant or a plant tissue of interest. Optionally, the plant cell, explant or tissue can be regenerated to produce a transgenic plant.

The plant can be any higher plant, including gymnosperms, monocotyledonous and dicotyledonous plants. Suitable protocols are available for Leguminosae (alfalfa, soybean, clover, etc.), Umbelliferae (carrot, celery, parsnip), Cruciferae (cabbage, radish, rapeseed, broccoli, etc.), Curcurbitaceae (melons and cucumber), Gramineae (wheat, corn, rice, barley, millet, etc.), Solanaceae (potato, tomato, tobacco, peppers, etc.), and various other crops (for example, in protocols described in Ammirato et al., eds., (1984) *Handbook of Plant Cell Culture—Crop Species*, Macmillan Publ. Co., New York, N.Y.; Shimamoto et al. (1989) *Nature* 338: 274-276; Fromm et al. (1990) *Bio/Technol.* 8: 833-839; and Vasil et al. (1990) *Bio/Technol.* 8: 429-434.

Transformation and regeneration of both monocotyledonous and dicotyledonous plant cells is now routine, and the selection of the most appropriate transformation technique will be determined by the practitioner. The choice of method will vary with the type of plant to be transformed; those skilled in the art will recognize the suitability of particular methods for given plant types. Suitable methods can include, but are not limited to: electroporation of plant protoplasts; liposome-mediated transformation; polyethylene glycol (PEG) mediated transformation; transformation using viruses; micro-injection of plant cells; micro-projectile bombardment of plant cells; vacuum infiltration; and *Agrobacterium tumefaciens* mediated transformation. Transformation means introducing a nucleotide sequence into a plant in a manner to cause stable or transient expression of the sequence.

Successful examples of the modification of plant characteristics by transformation with cloned sequences which serve to illustrate the current knowledge in this field of technology, and which are herein incorporated by reference, include: U.S. Pat. Nos. 5,571,706; 5,677,175; 5,510,471; 5,750,386; 5,597,945; 5,589,615; 5,750,871; 5,268,526; 5,780,708; 5,538,880; 5,773,269; 5,736,369 and 5,610,042.

Following transformation, plants are preferably selected using a dominant selectable marker incorporated into the transformation vector. Typically, such a marker will confer antibiotic or herbicide resistance on the transformed plants, and selection of transformants can be accomplished by exposing the plants to appropriate concentrations of the antibiotic or herbicide.

After transformed plants are selected and grown to maturity, those plants showing a modified trait are identified. The modified trait can be any of those traits described above. Additionally, to confirm that the modified trait is due to changes in expression levels or activity of the polypeptide or polynucleotide of the invention can be determined by analyzing mRNA expression using Northern blots, RT-PCR or microarrays, or protein expression using immunoblots or Western blots or gel shift assays.

Integrated Systems—Sequence Identity

Additionally, the present invention may be an integrated system, computer or computer readable medium that comprises an instruction set for determining the identity of one or more sequences in a database. In addition, the instruction set can be used to generate or identify sequences that meet any specified criteria. Furthermore, the instruction set may be used to associate or link certain functional benefits, such improved characteristics, with one or more identified sequence.

For example, the instruction set can include, for example, a sequence comparison or other alignment program, for example, an available program such as, for example, the Wisconsin Package Version 10.0, such as BLAST, FASTA, PILEUP, FINDPATTERNS or the like (GCG, Madison, Wis.). Public sequence databases such as GenBank, EMBL, Swiss-Prot and PIR or private sequence databases such as PHYTOSEQ sequence database (Incyte Genomics, Palo Alto, Calif.) can be searched.

Alignment of sequences for comparison can be conducted by the local homology algorithm of Smith and Waterman (1981) *Adv. Appl. Math.* 2: 482-489, by the homology alignment algorithm of Needleman and Wunsch (1970) *J. Mol. Biol.* 48: 443-453, by the search for similarity method of Pearson and Lipman (1988) *Proc. Natl. Acad. Sci.* 85: 2444-2448, by computerized implementations of these algorithms. After alignment, sequence comparisons between two (or more) polynucleotides or polypeptides are typically performed by comparing sequences of the two sequences over a comparison window to identify and compare local regions of sequence similarity. The comparison window can be a segment of at least about 20 contiguous positions, usually about 50 to about 200, more usually about 100 to about 150 contiguous positions. A description of the method is provided in Ausubel et al. supra.

A variety of methods for determining sequence relationships can be used, including manual alignment and computer assisted sequence alignment and analysis. This later approach is a preferred approach in the present invention, due to the increased throughput afforded by computer assisted methods. As noted above, a variety of computer programs for performing sequence alignment are available, or can be produced by one of skill.

One example algorithm that is suitable for determining percent sequence identity and sequence similarity is the BLAST algorithm, which is described in Altschul et al. (1990) *J. Mol. Biol.* 215: 403-410. Software for performing BLAST analyses is publicly available, for example, through the National Library of Medicine's National Center for Biotechnology Information (ncbi.nlm.nih; world wide web (www) National Institutes of Health US government (gov) website). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al. supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=-4, and a comparison of both strands. For amino acid sequences, the BLASTP program uses as defaults a wordlength (W) of 3, an expectation (E) of 10, and the BLOSUM62 scoring matrix (Henikoff and Henikoff (1992) *Proc. Natl. Acad. Sci.* 89: 10915-10919). Unless otherwise indicated, "sequence identity" here refers to the % sequence identity generated from a tblastx using the NCBI version of the algorithm at the default settings using gapped alignments with the filter "off" (for example, in the NIH NLM NCBI website at ncbi.nlm-.nih, supra).

In addition to calculating percent sequence identity, the BLAST algorithm also performs a statistical analysis of the similarity between two sequences (for example, in Karlin and Altschul (1993) *Proc. Natl. Acad. Sci.* 90: 5873-5787). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence (and, therefore, in this context, homologous) if the smallest sum probability in a comparison of the test nucleic acid to the reference nucleic acid is less than about 0.1, or less than about 0.01, and or even less than about 0.001. An additional example of a useful sequence alignment algorithm is PILEUP. PILEUP creates a multiple sequence alignment from a group of related sequences using progressive, pairwise alignments. The program can align, for example, up to 300 sequences of a maximum length of 5,000 letters.

The integrated system, or computer typically includes a user input interface allowing a user to selectively view one or more sequence records corresponding to the one or more character strings, as well as an instruction set which aligns the one or more character strings with each other or with an additional character string to identify one or more region of sequence similarity. The system may include a link of one or more character strings with a particular phenotype or gene function. Typically, the system includes a user readable output element that displays an alignment produced by the alignment instruction set.

The methods of this invention can be implemented in a localized or distributed computing environment. In a distributed environment, the methods may be implemented on a single computer comprising multiple processors or on a multiplicity of computers. The computers can be linked, for example, through a common bus, but more preferably the computer(s) are nodes on a network. The network can be a generalized or a dedicated local or wide-area network and, in certain preferred embodiments, the computers may be components of an intra-net or an internet.

Thus, the invention provides methods for identifying a sequence similar or homologous to one or more polynucleotides as noted herein, or one or more target polypeptides encoded by the polynucleotides, or otherwise noted herein and may include linking or associating a given plant phenotype or gene function with a sequence. In the methods, a sequence database is provided (locally or across an inter or intra net) and a query is made against the sequence database using the relevant sequences herein and associated plant phenotypes or gene functions.

Any sequence herein can be entered into the database, before or after querying the database. This provides for both expansion of the database and, if done before the querying step, for insertion of control sequences into the database. The control sequences can be detected by the query to ensure the general integrity of both the database and the query. As noted, the query can be performed using a web browser based interface. For example, the database can be a centralized public database such as those noted herein, and the querying can be done from a remote terminal or computer across an internet or intranet.

Any sequence herein can be used to identify a similar, homologous, paralogous, or orthologous sequence in another plant. This provides means for identifying endogenous sequences in other plants that may be useful to alter a trait of progeny plants, which results from crossing two plants of different strain. For example, sequences that encode an ortholog of any of the sequences herein that naturally occur in a plant with a desired trait can be identified using the sequences disclosed herein. The plant is then crossed with a second plant of the same species but which does not have the desired trait to produce progeny which can then be used in further crossing experiments to produce the desired trait in the second plant. Therefore the resulting progeny plant contains no transgenes; expression of the endogenous sequence may also be regulated by treatment with a particular chemical or other means, such as EMR. Some examples of such compounds well known in the art include: ethylene; cytokinins; phenolic compounds, which stimulate the transcription of the genes needed for infection; specific monosaccharides and acidic environments which potentiate vir gene induction; acidic polysaccharides which induce one or more chromosomal genes; and opines; other mechanisms include light or dark treatment (for example, in Winans (1992) *Microbiol. Rev.* 56: 12-31; Eyal et al. (1992) *Plant Mol. Biol.* 19: 589-599; Chrispeels et al. (2000) *Plant Mol. Biol.* 42: 279-290; Piazza et al. (2002) *Plant Physiol.* 128: 1077-1086).

Table 8 lists sequences within the UniGene database determined to be orthologous to a number of transcription factor sequences of the present invention. The column headings include the transcription factors listed by (a) the Clade Identifier SEQ ID NO: (the Reference *Arabidopsis* sequence used to identify each clade); (b) the GID of each Clade Identifier; (c) the AGI Identifier for each Clade Identifier; (d) the UniGene identifier for each orthologous sequence identified in this study; (e) the species from which the orthologs to the transcription factors are derived; and (f) the smallest sum probability relationship of the homologous sequence to *Arabidopsis* Clade Identifier sequence in a given row, determined by BLAST analysis.

TABLE 8

Orthologs of Representative *Arabidopsis* Transcription Factor Genes Identified Using BLAST

| Clade Identifier (SEQ ID NO:) | Clade Identifier (GID) | AGI Identifier for Clade Identifier | UniGene Identifier | Species | p-Value |
|---|---|---|---|---|---|
| 223 | G175 | AT4G26440 | Les_S5295446 | Lycopersicon esculentum | 1.00E−174 |
| 223 | G175 | AT4G26440 | Os_S121030 | Oryza sativa | 2.00E−77 |
| 223 | G175 | AT4G26440 | SGN-UNIGENE-57877 | Lycopersicon esculentum | 1.00E−75 |
| 223 | G175 | AT4G26440 | Zm_S11524014 | Zea mays | 9.00E−50 |
| 223 | G175 | AT4G26440 | SGN-UNIGENE-52888 | Lycopersicon esculentum | 7.00E−40 |
| 223 | G175 | AT4G26440 | SGN-UNIGENE-50193 | Lycopersicon esculentum | 6.00E−36 |
| 223 | G175 | AT4G26440 | Os_S50781 | Oryza sativa | 3.00E−19 |
| 255 | G184 | AT4G22070 | SGN-UNIGENE-47543 | Lycopersicon esculentum | 1.00E−104 |
| 255 | G184 | AT4G22070 | SGN-UNIGENE-47034 | Lycopersicon esculentum | 1.00E−100 |
| 255 | G184 | AT4G22070 | Gma_S6668474 | Glycine max | 2.00E−77 |
| 255 | G184 | AT4G22070 | SGN-UNIGENE-SINGLET-18500 | Lycopersicon esculentum | 2.00E−71 |
| 255 | G184 | AT4G22070 | SGN-UNIGENE-SINGLET-1941 | Lycopersicon esculentum | 5.00E−50 |
| 255 | G184 | AT4G22070 | SGN-UNIGENE-SINGLET-20683 | Lycopersicon esculentum | 8.00E−37 |
| 255 | G184 | AT4G22070 | SGN-UNIGENE-52279 | Lycopersicon esculentum | 5.00E−24 |
| 255 | G184 | AT4G22070 | Gma_S4878547 | Glycine max | 2.00E−12 |
| 255 | G184 | AT4G22070 | SGN-UNIGENE-SINGLET-2301 | Lycopersicon esculentum | 2.00E−11 |
| 255 | G184 | AT4G22070 | Hv_S119532 | Hordeum vulgare | 2.00E−10 |
| 255 | G184 | AT4G22070 | Zm_S11388469 | Zea mays | 2.00E−06 |
| 257 | G186 | AT1G62300 | SGN-UNIGENE-47543 | Lycopersicon esculentum | 1.00E−104 |
| 257 | G186 | AT1G62300 | SGN-UNIGENE-47034 | Lycopersicon esculentum | 1.00E−100 |
| 257 | G186 | AT1G62300 | Gma_S6668474 | Glycine max | 2.00E−77 |
| 257 | G186 | AT1G62300 | SGN-UNIGENE-SINGLET-18500 | Lycopersicon esculentum | 2.00E−71 |
| 257 | G186 | AT1G62300 | SGN-UNIGENE-SINGLET-1941 | Lycopersicon esculentum | 5.00E−50 |
| 257 | G186 | AT1G62300 | SGN-UNIGENE-SINGLET-20683 | Lycopersicon esculentum | 8.00E−37 |
| 257 | G186 | AT1G62300 | SGN-UNIGENE-52279 | Lycopersicon esculentum | 5.00E−24 |
| 257 | G186 | AT1G62300 | Gma_S4878547 | Glycine max | 2.00E−12 |
| 257 | G186 | AT1G62300 | SGN-UNIGENE-SINGLET-2301 | Lycopersicon esculentum | 2.00E−11 |
| 257 | G186 | AT1G62300 | Hv_S119532 | Hordeum vulgare | 2.00E−10 |
| 257 | G186 | AT1G62300 | Zm_S11388469 | Zea mays | 2.00E−06 |
| 259 | G353 | AT5G59820 | SGN-UNIGENE-56766 | Lycopersicon esculentum | 6.00E−32 |
| 259 | G353 | AT5G59820 | Gma_S4898433 | Glycine max | 3.00E−26 |
| 259 | G353 | AT5G59820 | Ta_S200273 | Triticum aestivum | 1.00E−24 |
| 259 | G353 | AT5G59820 | Os_S109163 | Oryza sativa | 2.00E−20 |
| 259 | G353 | AT5G59820 | Gma_S4973977 | Glycine max | 9.00E−17 |
| 259 | G353 | AT5G59820 | Ta_S111267 | Triticum aestivum | 3.00E−16 |
| 259 | G353 | AT5G59820 | Mtr_S5397852 | Medicago truncatula | 2.00E−14 |
| 259 | G353 | AT5G59820 | Hv_S207187 | Hordeum vulgare | 5.00E−10 |
| 259 | G353 | AT5G59820 | Ta_S296415 | Triticum aestivum | 1.00E−05 |
| 227 | G354 | AT3G46090 | SGN-UNIGENE-56766 | Lycopersicon esculentum | 6.00E−32 |
| 227 | G354 | AT3G46090 | Gma_S4898433 | Glycine max | 3.00E−26 |
| 227 | G354 | AT3G46090 | Ta_S200273 | Triticum aestivum | 1.00E−24 |
| 227 | G354 | AT3G46090 | Os_S109163 | Oryza sativa | 2.00E−20 |
| 227 | G354 | AT3G46090 | Gma_S4973977 | Glycine max | 9.00E−17 |
| 227 | G354 | AT3G46090 | Ta_S111267 | Triticum aestivum | 3.00E−16 |
| 227 | G354 | AT3G46090 | Mtr_S5397852 | Medicago truncatula | 2.00E−14 |
| 227 | G354 | AT3G46090 | Hv_S207187 | Hordeum vulgare | 5.00E−10 |
| 227 | G354 | AT3G46090 | Ta_S296415 | Triticum aestivum | 1.00E−05 |
| 229 | G489 | AT1G08970 | Vvi_S16526885 | Vitis vinifera | 1.00E−77 |
| 229 | G489 | AT1G08970 | SGN-UNIGENE-45265 | Lycopersicon esculentum | 4.00E−75 |
| 229 | G489 | AT1G08970 | Mtr_S5463839 | Medicago truncatula | 6.00E−73 |
| 229 | G489 | AT1G08970 | Les_S5293479 | Lycopersicon esculentum | 2.00E−69 |
| 229 | G489 | AT1G08970 | Mtr_S7092400 | Medicago truncatula | 9.00E−66 |
| 229 | G489 | AT1G08970 | Pta_S17047341 | Pinus taeda | 7.00E−48 |

TABLE 8-continued

Orthologs of Representative *Arabidopsis* Transcription Factor Genes Identified Using BLAST

| Clade Identifier (SEQ ID NO:) | Clade Identifier (GID) | AGI Identifier for Clade Identifier | UniGene Identifier | Species | p-Value |
|---|---|---|---|---|---|
| 229 | G489 | AT1G08970 | SGN-UNIGENE-45266 | *Lycopersicon esculentum* | 2.00E−36 |
| 229 | G489 | AT1G08970 | Os_S37232 | *Oryza sativa* | 5.00E−09 |
| 229 | G489 | AT1G08970 | Vvi_S15374122 | *Vitis vinifera* | 2.00E−08 |
| 263 | G596 | AT2G45430 | Pta_S16786360 | *Pinus taeda* | 2.00E−70 |
| 263 | G596 | AT2G45430 | Gma_S4935598 | *Glycine max* | 2.00E−67 |
| 263 | G596 | AT2G45430 | Pta_S16788492 | *Pinus taeda* | 7.00E−63 |
| 263 | G596 | AT2G45430 | Pta_S16802054 | *Pinus taeda* | 1.00E−57 |
| 263 | G596 | AT2G45430 | Pta_S15799222 | *Pinus taeda* | 6.00E−43 |
| 231 | G634 | AT1G33240 | Pta_S17050439 | *Pinus taeda* | 3.00E−39 |
| 231 | G634 | AT1G33240 | Zm_S11449298 | *Zea mays* | 3.00E−35 |
| 233 | G682 | AT4G01060 | Vvi_S15356289 | *Vitis vinifera* | 2.00E−30 |
| 233 | G682 | AT4G01060 | Ta_S45274 | *Triticum aestivum* | 3.00E−14 |
| 233 | G682 | AT4G01060 | Vvi_S16820566 | *Vitis vinifera* | 3.00E−12 |
| 233 | G682 | AT4G01060 | Gma_S4901946 | *Glycine max* | 0.004 |
| 265 | G714 | AT1G54830 | Vvi_S16526885 | *Vitis vinifera* | 1.00E−77 |
| 265 | G714 | AT1G54830 | SGN-UNIGENE-45265 | *Lycopersicon esculentum* | 4.00E−75 |
| 265 | G714 | AT1G54830 | Mtr_S5463839 | *Medicago truncatula* | 6.00E−73 |
| 265 | G714 | AT1G54830 | Les_S5293479 | *Lycopersicon esculentum* | 2.00E−69 |
| 265 | G714 | AT1G54830 | Mtr_S7092400 | *Medicago truncatula* | 9.00E−66 |
| 265 | G714 | AT1G54830 | Pta_S17047341 | *Pinus taeda* | 7.00E−48 |
| 265 | G714 | AT1G54830 | SGN-UNIGENE-45266 | *Lycopersicon esculentum* | 2.00E−36 |
| 265 | G714 | AT1G54830 | Os_S37232 | *Oryza sativa* | 5.00E−09 |
| 267 | G877 | AT5G56270 | Les_S5295446 | *Lycopersicon esculentum* | 1.00E−174 |
| 267 | G877 | AT5G56270 | Os_S121030 | *Oryza sativa* | 2.00E−77 |
| 267 | G877 | AT5G56270 | SGN-UNIGENE-57877 | *Lycopersicon esculentum* | 1.00E−75 |
| 267 | G877 | AT5G56270 | Zm_S11524014 | *Zea mays* | 9.00E−50 |
| 267 | G877 | AT5G56270 | SGN-UNIGENE-52888 | *Lycopersicon esculentum* | 7.00E−40 |
| 267 | G877 | AT5G56270 | SGN-UNIGENE-50193 | *Lycopersicon esculentum* | 6.00E−36 |
| 267 | G877 | AT5G56270 | Os_S50781 | *Oryza sativa* | 3.00E−19 |
| 267 | G877 | AT5G56270 | SGN-UNIGENE-56707 | *Lycopersicon esculentum* | 7.00E−10 |
| 235 | G916 | AT4G04450 | SGN-UNIGENE-47543 | *Lycopersicon esculentum* | 1.00E−104 |
| 235 | G916 | AT4G04450 | SGN-UNIGENE-47034 | *Lycopersicon esculentum* | 1.00E−100 |
| 235 | G916 | AT4G04450 | Gma_S6668474 | *Glycine max* | 2.00E−77 |
| 235 | G916 | AT4G04450 | SGN-UNIGENE-SINGLET-18500 | *Lycopersicon esculentum* | 2.00E−71 |
| 235 | G916 | AT4G04450 | SGN-UNIGENE-SINGLET-1941 | *Lycopersicon esculentum* | 5.00E−50 |
| 235 | G916 | AT4G04450 | SGN-UNIGENE-SINGLET-20683 | *Lycopersicon esculentum* | 8.00E−37 |
| 235 | G916 | AT4G04450 | SGN-UNIGENE-52279 | *Lycopersicon esculentum* | 5.00E−24 |
| 235 | G916 | AT4G04450 | Gma_S4878547 | *Glycine max* | 2.00E−12 |
| 235 | G916 | AT4G04450 | Hv_S119532 | *Hordeum vulgare* | 2.00E−10 |
| 235 | G916 | AT4G04450 | Zm_S11388469 | *Zea mays* | 2.00E−06 |
| 237 | G975 | AT1G15360 | SGN-UNIGENE-SINGLET-335836 | *Lycopersicon esculentum* | 9.00E−59 |
| 237 | G975 | AT1G15360 | SGN-UNIGENE-SINGLET-14957 | *Lycopersicon esculentum* | 2.00E−52 |
| 239 | G1069 | AT4G14465 | SGN-UNIGENE-59076 | *Lycopersicon esculentum* | 6.00E−55 |
| 239 | G1069 | AT4G14465 | Vvi_S16805621 | *Vitis vinifera* | 1.00E−04 |
| 271 | G1387 | AT5G25390 | SGN-UNIGENE-SINGLET-335836 | *Lycopersicon esculentum* | 9.00E−59 |
| 271 | G1387 | AT5G25390 | SGN-UNIGENE-SINGLET-14957 | *Lycopersicon esculentum* | 2.00E−52 |
| 273 | G1634 | AT5G05790 | Vvi_S16872328 | *Vitis vinifera* | 4.00E−63 |
| 273 | G1634 | AT5G05790 | SGN-UNIGENE-SINGLET-48341 | *Lycopersicon esculentum* | 5.00E−34 |
| 273 | G1634 | AT5G05790 | SGN-UNIGENE-SINGLET-41892 | *Lycopersicon esculentum* | 4.00E−12 |
| 275 | G1889 | AT2G28710 | SGN-UNIGENE-56766 | *Lycopersicon esculentum* | 6.00E−32 |
| 275 | G1889 | AT2G28710 | Gma_S4898433 | *Glycine max* | 3.00E−26 |
| 275 | G1889 | AT2G28710 | Ta_S200273 | *Triticum aestivum* | 1.00E−24 |
| 275 | G1889 | AT2G28710 | Os_S109163 | *Oryza sativa* | 2.00E−20 |
| 275 | G1889 | AT2G28710 | Gma_S4973977 | *Glycine max* | 9.00E−17 |
| 275 | G1889 | AT2G28710 | Ta_S111267 | *Triticum aestivum* | 3.00E−16 |
| 275 | G1889 | AT2G28710 | Mtr_S5397852 | *Medicago truncatula* | 2.00E−14 |
| 275 | G1889 | AT2G28710 | Hv_S207187 | *Hordeum vulgare* | 5.00E−10 |
| 277 | G1940 | AT5G54900 | SGN-UNIGENE-44207 | *Lycopersicon esculentum* | 1.00E−144 |
| 277 | G1940 | AT5G54900 | Zm_S11525357 | *Zea mays* | 1.00E−130 |
| 277 | G1940 | AT5G54900 | Zm_S11522955 | *Zea mays* | 1.00E−100 |
| 277 | G1940 | AT5G54900 | Vvi_S16865171 | *Vitis vinifera* | 1.00E−85 |
| 277 | G1940 | AT5G54900 | Hv_S153237 | *Hordeum vulgare* | 9.00E−72 |
| 277 | G1940 | AT5G54900 | Ta_S152820 | *Triticum aestivum* | 1.00E−66 |

TABLE 8-continued

Orthologs of Representative *Arabidopsis* Transcription Factor Genes Identified Using BLAST

| Clade Identifier (SEQ ID NO:) | Clade Identifier (GID) | AGI Identifier for Clade Identifier | UniGene Identifier | Species | p-Value |
|---|---|---|---|---|---|
| 277 | G1940 | AT5G54900 | SGN-UNIGENE-SINGLET-396174 | *Lycopersicon esculentum* | 3.00E−55 |
| 277 | G1940 | AT5G54900 | SGN-UNIGENE-SINGLET-333119 | *Lycopersicon esculentum* | 4.00E−53 |
| 277 | G1940 | AT5G54900 | Gma_S4975207 | *Glycine max* | 6.00E−51 |
| 277 | G1940 | AT5G54900 | SGN-UNIGENE-SINGLET-17539 | *Lycopersicon esculentum* | 1.00E−51 |
| 277 | G1940 | AT5G54900 | Hv_S63965 | *Hordeum vulgare* | 4.00E−43 |
| 277 | G1940 | AT5G54900 | SGN-UNIGENE-56600 | *Lycopersicon esculentum* | 2.00E−43 |
| 277 | G1940 | AT5G54900 | Os_S32676 | *Oryza sativa* | 2.00E−31 |
| 277 | G1940 | AT5G54900 | Ta_S125786 | *Triticum aestivum* | 6.00E−26 |
| 277 | G1940 | AT5G54900 | Ta_S267457 | *Triticum aestivum* | 5.00E−24 |
| 277 | G1940 | AT5G54900 | Vvi_S16866336 | *Vitis vinifera* | 7.00E−18 |
| 277 | G1940 | AT5G54900 | Os_S75860 | *Oryza sativa* | 4.00E−11 |
| 277 | G1940 | AT5G54900 | SGN-UNIGENE-SINGLET-49629 | *Lycopersicon esculentum* | 2.00E−04 |
| 279 | G1974 | AT3G46070 | SGN-UNIGENE-56766 | *Lycopersicon esculentum* | 6.00E−32 |
| 279 | G1974 | AT3G46070 | Gma_S4898433 | *Glycine max* | 3.00E−26 |
| 279 | G1974 | AT3G46070 | Ta_S200273 | *Triticum aestivum* | 1.00E−24 |
| 279 | G1974 | AT3G46070 | Os_S109163 | *Oryza sativa* | 2.00E−20 |
| 279 | G1974 | AT3G46070 | Gma_S4973977 | *Glycine max* | 9.00E−17 |
| 279 | G1974 | AT3G46070 | Ta_S111267 | *Triticum aestivum* | 3.00E−16 |
| 279 | G1974 | AT3G46070 | Mtr_S5397852 | *Medicago truncatula* | 2.00E−14 |
| 279 | G1974 | AT3G46070 | Hv_S207187 | *Hordeum vulgare* | 5.00E−10 |
| 279 | G1974 | AT3G46070 | Ta_S296415 | *Triticum aestivum* | 1.00E−05 |
| 281 | G2153 | AT3G04570 | SGN-UNIGENE-59076 | *Lycopersicon esculentum* | 6.00E−55 |
| 281 | G2153 | AT3G04570 | Mtr_S5308977 | *Medicago truncatula* | 2.00E−31 |
| 281 | G2153 | AT3G04570 | Hv_S52928 | *Hordeum vulgare* | 5 |
| 283 | G2583 | AT5G11190 | SGN-UNIGENE-SINGLET-335836 | *Lycopersicon esculentum* | 9.00E−59 |
| 283 | G2583 | AT5G11190 | SGN-UNIGENE-SINGLET-14957 | *Lycopersicon esculentum* | 2.00E−52 |
| 245 | G2701 | AT3G11280 | Vvi_S16872328 | *Vitis vinifera* | 4.00E−63 |
| 245 | G2701 | AT3G11280 | SGN-UNIGENE-SINGLET-48341 | *Lycopersicon esculentum* | 5.00E−34 |
| 245 | G2701 | AT3G11280 | SGN-UNIGENE-SINGLET-41892 | *Lycopersicon esculentum* | 4.00E−12 |
| 247 | G2789 | AT3G60870 | Pta_S16786360 | *Pinus taeda* | 2.00E−70 |
| 247 | G2789 | AT3G60870 | Gma_S4935598 | *Glycine max* | 2.00E−67 |
| 247 | G2789 | AT3G60870 | Pta_S16788492 | *Pinus taeda* | 7.00E−63 |
| 247 | G2789 | AT3G60870 | Pta_S16802054 | *Pinus taeda* | 1.00E−57 |
| 247 | G2789 | AT3G60870 | Pta_S15799222 | *Pinus taeda* | 6.00E−43 |
| 249 | G2839 | AT3G46080 | SGN-UNIGENE-56766 | *Lycopersicon esculentum* | 6.00E−32 |
| 249 | G2839 | AT3G46080 | Gma_S4898433 | *Glycine max* | 3.00E−26 |
| 249 | G2839 | AT3G46080 | Ta_S200273 | *Triticum aestivum* | 1.00E−24 |
| 249 | G2839 | AT3G46080 | Os_S109163 | *Oryza sativa* | 2.00E−20 |
| 249 | G2839 | AT3G46080 | Gma_S4973977 | *Glycine max* | 9.00E−17 |
| 249 | G2839 | AT3G46080 | Ta_S111267 | *Triticum aestivum* | 3.00E−16 |
| 249 | G2839 | AT3G46080 | Mtr_S5397852 | *Medicago truncatula* | 2.00E−14 |
| 249 | G2839 | AT3G46080 | Hv_S207187 | *Hordeum vulgare* | 5.00E−10 |
| 249 | G2839 | AT3G46080 | Ta_S296415 | *Triticum aestivum* | 1.00E−05 |
| 251 | G2854 | AT4G27000 | SGN-UNIGENE-44207 | *Lycopersicon esculentum* | 1.00E−144 |
| 251 | G2854 | AT4G27000 | Zm_S11525357 | *Zea mays* | 1.00E−130 |
| 251 | G2854 | AT4G27000 | Zm_S11522955 | *Zea mays* | 1.00E−100 |
| 251 | G2854 | AT4G27000 | Vvi_S16865171 | *Vitis vinifera* | 1.00E−85 |
| 251 | G2854 | AT4G27000 | Hv_S153237 | *Hordeum vulgare* | 9.00E−72 |
| 251 | G2854 | AT4G27000 | Ta_S152820 | *Triticum aestivum* | 1.00E−66 |
| 251 | G2854 | AT4G27000 | SGN-UNIGENE-SINGLET-396174 | *Lycopersicon esculentum* | 3.00E−55 |
| 251 | G2854 | AT4G27000 | SGN-UNIGENE-SINGLET-333119 | *Lycopersicon esculentum* | 4.00E−53 |
| 251 | G2854 | AT4G27000 | Gma_S4975207 | *Glycine max* | 6.00E−51 |
| 251 | G2854 | AT4G27000 | SGN-UNIGENE-SINGLET-17539 | *Lycopersicon esculentum* | 1.00E−51 |
| 251 | G2854 | AT4G27000 | Hv_S63965 | *Hordeum vulgare* | 4.00E−43 |
| 251 | G2854 | AT4G27000 | SGN-UNIGENE-56600 | *Lycopersicon esculentum* | 2.00E−43 |
| 251 | G2854 | AT4G27000 | Os_S32676 | *Oryza sativa* | 2.00E−31 |
| 251 | G2854 | AT4G27000 | Ta_S125786 | *Triticum aestivum* | 6.00E−26 |
| 251 | G2854 | AT4G27000 | Ta_S267457 | *Triticum aestivum* | 5.00E−24 |
| 251 | G2854 | AT4G27000 | Vvi_S16866336 | *Vitis vinifera* | 7.00E−18 |
| 251 | G2854 | AT4G27000 | Os_S75860 | *Oryza sativa* | 4.00E−11 |
| 251 | G2854 | AT4G27000 | SGN-UNIGENE-SINGLET-49629 | *Lycopersicon esculentum* | 2.00E−04 |

TABLE 8-continued

Orthologs of Representative *Arabidopsis* Transcription Factor Genes Identified Using BLAST

| Clade Identifier (SEQ ID NO:) | Clade Identifier (GID) | AGI Identifier for Clade Identifier | UniGene Identifier | Species | p-Value |
|---|---|---|---|---|---|
| 253 | G3083 | AT3G14880 | Gma_S4880456 | *Glycine max* | 1.00E−25 |
| 253 | G3083 | AT3G14880 | Ta_S179586 | *Triticum aestivum* | 1.00E−13 |
| 253 | G3083 | AT3G14880 | Os_S54214 | *Oryza sativa* | 5.00E−08 |
| 253 | G3083 | AT3G14880 | Hv_S60182 | *Hordeum vulgare* | 3.00E−06 |
| 463 | G8 | AT2G28550 | SGN-UNIGENE-SINGLET-395477 | *Lycopersicon esculentum* | 1.00E−64 |
| 463 | G8 | AT2G28550 | Ta_S177690 | *Triticum aestivum* | 2.00E−21 |
| 463 | G8 | AT2G28550 | Vvi_S15411435 | *Vitis vinifera* | 6.00E−07 |
| 419 | G24 | AT2G23340 | Gma_S5071803 | *Glycine max* | 8.00E−40 |
| 419 | G24 | AT2G23340 | SGN-UNIGENE-49683 | *Lycopersicon esculentum* | 1.00E−14 |
| 419 | G24 | AT2G23340 | SGN-UNIGENE-54594 | *Lycopersicon esculentum* | 4.00E−41 |
| 419 | G24 | AT2G23340 | SGN-UNIGENE-SINGLET-47313 | *Lycopersicon esculentum* | 7.00E−19 |
| 419 | G24 | AT2G23340 | Mtr_S5349908 | *Medicago truncatula* | 4.00E−32 |
| 419 | G24 | AT2G23340 | Os_S32369 | *Oryza sativa* | 1.00E−13 |
| 419 | G24 | AT2G23340 | Os_S80194 | *Oryza sativa* | 4.00E−08 |
| 419 | G24 | AT2G23340 | Vvi_S15370190 | *Vitis vinifera* | 1.00E−38 |
| 419 | G24 | AT2G23340 | Vvi_S16806812 | *Vitis vinifera* | 6.00E−25 |
| 421 | G154 | AT2G45660 | Gma_S5094568 | *Glycine max* | 2.00E−13 |
| 421 | G154 | AT2G45660 | Les_S5295933 | *Lycopersicon esculentum* | 2.00E−57 |
| 421 | G154 | AT2G45660 | SGN-UNIGENE-50586 | *Lycopersicon esculentum* | 4.00E−56 |
| 421 | G154 | AT2G45660 | SGN-UNIGENE-52410 | *Lycopersicon esculentum* | 2.00E−54 |
| 421 | G154 | AT2G45660 | SGN-UNIGENE-SINGLET-366830 | *Lycopersicon esculentum* | 2.00E−27 |
| 421 | G154 | AT2G45660 | SGN-UNIGENE-SINGLET-394847 | *Lycopersicon esculentum* | 3.00E−47 |
| 421 | G154 | AT2G45660 | Mtr_S5357829 | *Medicago truncatula* | 2.00E−53 |
| 421 | G154 | AT2G45660 | Os_S60918 | *Oryza sativa* | 1.00E−57 |
| 421 | G154 | AT2G45660 | Pta_S15732813 | *Pinus taeda* | 5.00E−13 |
| 421 | G154 | AT2G45660 | Pta_S15736271 | *Pinus taeda* | 2.00E−37 |
| 421 | G154 | AT2G45660 | Pta_S15739572 | *Pinus taeda* | 4.00E−22 |
| 421 | G154 | AT2G45660 | Pta_S15740527 | *Pinus taeda* | 8.00E−31 |
| 421 | G154 | AT2G45660 | Pta_S15746398 | *Pinus taeda* | 6.00E−26 |
| 421 | G154 | AT2G45660 | Pta_S15751737 | *Pinus taeda* | 2.00E−39 |
| 421 | G154 | AT2G45660 | Pta_S15777399 | *Pinus taeda* | 3.00E−22 |
| 421 | G154 | AT2G45660 | Pta_S15780122 | *Pinus taeda* | 1.00E−36 |
| 421 | G154 | AT2G45660 | Pta_S15795745 | *Pinus taeda* | 1.00E−23 |
| 421 | G154 | AT2G45660 | Pta_S16849782 | *Pinus taeda* | 3.00E−55 |
| 421 | G154 | AT2G45660 | Ta_S203038 | *Triticum aestivum* | 3.00E−47 |
| 421 | G154 | AT2G45660 | Ta_S424724 | *Triticum aestivum* | 8.00E−19 |
| 421 | G154 | AT2G45660 | Vvi_S15373999 | *Vitis vinifera* | 4.00E−72 |
| 421 | G154 | AT2G45660 | Vvi_S16872184 | *Vitis vinifera* | 7.00E−35 |
| 421 | G154 | AT2G45660 | Zm_S11418746 | *Zea mays* | 2.00E−58 |
| 421 | G154 | AT2G45660 | Zm_S11527819 | *Zea mays* | 6.00E−55 |
| 467 | G156 | AT5G23260 | SGN-UNIGENE-54690 | *Lycopersicon esculentum* | 5.00E−40 |
| 469 | G161 | AT5G60440 | SGN-UNIGENE-57990 | *Lycopersicon esculentum* | 3.00E−20 |
| 475 | G189 | AT2G23320 | Gma_S4901804 | *Glycine max* | 3.00E−15 |
| 475 | G189 | AT2G23320 | Les_S6657758 | *Lycopersicon esculentum* | 2.00E−22 |
| 475 | G189 | AT2G23320 | Pta_S16793418 | *Pinus taeda* | 1.00E−36 |
| 475 | G189 | AT2G23320 | Vvi_S15353287 | *Vitis vinifera* | 1.00E−29 |
| 475 | G189 | AT2G23320 | Vvi_S15374453 | *Vitis vinifera* | 9.00E−32 |
| 477 | G200 | AT1G08810 | SGN-UNIGENE-57276 | *Lycopersicon esculentum* | 9.00E−10 |
| 477 | G200 | AT1G08810 | SGN-UNIGENE-SINGLET-385670 | *Lycopersicon esculentum* | 1.00E−61 |
| 477 | G200 | AT1G08810 | Os_S60479 | *Oryza sativa* | 9.00E−71 |
| 477 | G200 | AT1G08810 | Zm_S11529138 | *Zea mays* | 9.00E−18 |
| 477 | G200 | AT1G08810 | Zm_S11529143 | *Zea mays* | 1.00E−19 |
| 477 | G200 | AT1G08810 | Zm_S11529165 | *Zea mays* | 8.00E−19 |
| 479 | G234 | AT3G49690 | SGN-UNIGENE-SINGLET-21166 | *Lycopersicon esculentum* | 3.00E−57 |
| 479 | G234 | AT3G49690 | Zm_S11529159 | *Zea mays* | 3.00E−15 |
| 479 | G234 | AT3G49690 | Zm_S11529194 | *Zea mays* | 3.00E−16 |
| 483 | G275 | AT5G64030 | Gma_S4898629 | *Glycine max* | 1.00E−93 |
| 483 | G275 | AT5G64030 | Gma_S4907362 | *Glycine max* | 1.00E−16 |
| 483 | G275 | AT5G64030 | Hv_S8292 | *Hordeum vulgare* | 2.00E−71 |
| 483 | G275 | AT5G64030 | SGN-UNIGENE-47489 | *Lycopersicon esculentum* | 1.0e−999 |
| 483 | G275 | AT5G64030 | SGN-UNIGENE-47510 | *Lycopersicon esculentum* | 1.00E−121 |
| 483 | G275 | AT5G64030 | SGN-UNIGENE-51256 | *Lycopersicon esculentum* | 1.00E−142 |
| 483 | G275 | AT5G64030 | SGN-UNIGENE-56050 | *Lycopersicon esculentum* | 2.00E−54 |
| 483 | G275 | AT5G64030 | Mtr_S10821012 | *Medicago truncatula* | 1.00E−117 |
| 483 | G275 | AT5G64030 | Pta_S15736214 | *Pinus taeda* | 1.00E−48 |
| 483 | G275 | AT5G64030 | Pta_S15776645 | *Pinus taeda* | 1.00E−74 |
| 483 | G275 | AT5G64030 | Vvi_S15426449 | *Vitis vinifera* | 1.00E−118 |

TABLE 8-continued

Orthologs of Representative *Arabidopsis* Transcription Factor Genes Identified Using BLAST

| Clade Identifier (SEQ ID NO:) | Clade Identifier (GID) | AGI Identifier for Clade Identifier | UniGene Identifier | Species | p-Value |
|---|---|---|---|---|---|
| 483 | G275 | AT5G64030 | Vvi_S16870363 | *Vitis vinifera* | 6.00E−23 |
| 483 | G275 | AT5G64030 | Zm_S11528144 | *Zea mays* | 1.0e−999 |
| 485 | G326 | AT2G33500 | Hv_S67575 | *Hordeum vulgare* | 4.00E−12 |
| 485 | G326 | AT2G33500 | SGN-UNIGENE-SINGLET-19083 | *Lycopersicon esculentum* | 1.00E−45 |
| 485 | G326 | AT2G33500 | Pta_S17049915 | *Pinus taeda* | 9.00E−17 |
| 485 | G326 | AT2G33500 | Ta_S148486 | *Triticum aestivum* | 2.00E−12 |
| 485 | G326 | AT2G33500 | Zm_S11450524 | *Zea mays* | 1.00E−18 |
| 485 | G326 | AT2G33500 | Zm_S11510508 | *Zea mays* | 1.00E−11 |
| 487 | G347 | AT4G20380 | Gma_S4934838 | *Glycine max* | 1.00E−12 |
| 487 | G347 | AT4G20380 | Les_S5275585 | *Lycopersicon esculentum* | 3.00E−22 |
| 487 | G347 | AT4G20380 | SGN-UNIGENE-51747 | *Lycopersicon esculentum* | 5.00E−29 |
| 487 | G347 | AT4G20380 | Mtr_S5454462 | *Medicago truncatula* | 1.00E−72 |
| 487 | G347 | AT4G20380 | Os_S100515 | *Oryza sativa* | 9.00E−09 |
| 487 | G347 | AT4G20380 | Ta_S64707 | *Triticum aestivum* | 2.00E−54 |
| 487 | G347 | AT4G20380 | Vvi_S16531517 | *Vitis vinifera* | 3.00E−66 |
| 487 | G347 | AT4G20380 | Zm_S11437336 | *Zea mays* | 1.00E−19 |
| 487 | G347 | AT4G20380 | Zm_S11520104 | *Zea mays* | 3.00E−53 |
| 423 | G384 | AT4G21750 | Gma_S4992142 | *Glycine max* | 3.00E−23 |
| 423 | G384 | AT4G21750 | Hv_S30279 | *Hordeum vulgare* | 7.00E−22 |
| 423 | G384 | AT4G21750 | SGN-UNIGENE-SINGLET-17776 | *Lycopersicon esculentum* | 4.00E−60 |
| 423 | G384 | AT4G21750 | Mtr_S5447672 | *Medicago truncatula* | 1.00E−123 |
| 423 | G384 | AT4G21750 | Os_S112966 | *Oryza sativa* | 1.0e−999 |
| 423 | G384 | AT4G21750 | Os_S113503 | *Oryza sativa* | 2.00E−93 |
| 423 | G384 | AT4G21750 | Ta_S133393 | *Triticum aestivum* | 3.00E−12 |
| 423 | G384 | AT4G21750 | Zm_S11333633 | *Zea mays* | 1.00E−28 |
| 423 | G384 | AT4G21750 | Zm_S11401894 | *Zea mays* | 9.00E−16 |
| 423 | G384 | AT4G21750 | Zm_S11418286 | *Zea mays* | 1.0e−999 |
| 423 | G384 | AT4G21750 | Zm_S11418453 | *Zea mays* | 1.0e−999 |
| 423 | G384 | AT4G21750 | Zm_S11418455 | *Zea mays* | 1.0e−999 |
| 423 | G384 | AT4G21750 | Zm_S11523949 | *Zea mays* | 4.00E−09 |
| 489 | G427 | AT5G11060 | Gma_S4867945 | *Glycine max* | 7.00E−49 |
| 489 | G427 | AT5G11060 | Hv_S23303 | *Hordeum vulgare* | 3.00E−82 |
| 489 | G427 | AT5G11060 | Les_S5295728 | *Lycopersicon esculentum* | 1.00E−125 |
| 489 | G427 | AT5G11060 | Les_S5295749 | *Lycopersicon esculentum* | 1.00E−137 |
| 489 | G427 | AT5G11060 | SGN-UNIGENE-51523 | *Lycopersicon esculentum* | 2.00E−46 |
| 489 | G427 | AT5G11060 | SGN-UNIGENE-54900 | *Lycopersicon esculentum* | 5.00E−12 |
| 489 | G427 | AT5G11060 | SGN-UNIGENE-55550 | *Lycopersicon esculentum* | 1.00E−140 |
| 489 | G427 | AT5G11060 | SGN-UNIGENE-55551 | *Lycopersicon esculentum* | 4.00E−49 |
| 489 | G427 | AT5G11060 | SGN-UNIGENE-SINGLET-397654 | *Lycopersicon esculentum* | 4.00E−16 |
| 489 | G427 | AT5G11060 | SGN-UNIGENE-SINGLET-446384 | *Lycopersicon esculentum* | 8.00E−09 |
| 489 | G427 | AT5G11060 | SGN-UNIGENE-SINGLET-50339 | *Lycopersicon esculentum* | 2.00E−75 |
| 489 | G427 | AT5G11060 | SGN-UNIGENE-SINGLET-9520 | *Lycopersicon esculentum* | 3.00E−49 |
| 489 | G427 | AT5G11060 | Mtr_S5306926 | *Medicago truncatula* | 7.00E−38 |
| 489 | G427 | AT5G11060 | Mtr_S5449876 | *Medicago truncatula* | 2.00E−82 |
| 489 | G427 | AT5G11060 | Mtr_S7092065 | *Medicago truncatula* | 5.00E−85 |
| 489 | G427 | AT5G11060 | Os_S60901 | *Oryza sativa* | 5.00E−89 |
| 489 | G427 | AT5G11060 | Os_S64872 | *Oryza sativa* | 2.00E−94 |
| 489 | G427 | AT5G11060 | Os_S64899 | *Oryza sativa* | 1.00E−118 |
| 489 | G427 | AT5G11060 | Os_S64900 | *Oryza sativa* | 1.00E−114 |
| 489 | G427 | AT5G11060 | Pta_S16847381 | *Pinus taeda* | 1.00E−110 |
| 489 | G427 | AT5G11060 | Pta_S17051722 | *Pinus taeda* | 4.00E−66 |
| 489 | G427 | AT5G11060 | Ta_S16327 | *Triticum aestivum* | 3.00E−93 |
| 489 | G427 | AT5G11060 | Ta_S201090 | *Triticum aestivum* | 2.00E−47 |
| 489 | G427 | AT5G11060 | Vvi_S15401282 | *Vitis vinifera* | 8.00E−19 |
| 489 | G427 | AT5G11060 | Vvi_S15423741 | *Vitis vinifera* | 4.00E−58 |
| 489 | G427 | AT5G11060 | Zm_S11442066 | *Zea mays* | 2.00E−08 |
| 489 | G427 | AT5G11060 | Zm_S11452342 | *Zea mays* | 3.00E−48 |
| 489 | G427 | AT5G11060 | Zm_S11527509 | *Zea mays* | 4.00E−86 |
| 425 | G545 | AT1G27730 | Gma_S4873409 | *Glycine max* | 1.00E−50 |
| 425 | G545 | AT1G27730 | Gma_S5146663 | *Glycine max* | 2.00E−55 |
| 425 | G545 | AT1G27730 | SGN-UNIGENE-44163 | *Lycopersicon esculentum* | 1.00E−56 |
| 425 | G545 | AT1G27730 | SGN-UNIGENE-44287 | *Lycopersicon esculentum* | 2.00E−35 |
| 425 | G545 | AT1G27730 | SGN-UNIGENE-SINGLET-6983 | *Lycopersicon esculentum* | 4.00E−33 |
| 425 | G545 | AT1G27730 | Mtr_S5317695 | *Medicago truncatula* | 4.00E−55 |
| 425 | G545 | AT1G27730 | Mtr_S5431156 | *Medicago truncatula* | 5.00E−40 |
| 425 | G545 | AT1G27730 | Ta_S147812 | *Triticum aestivum* | 9.00E−16 |

TABLE 8-continued

Orthologs of Representative *Arabidopsis* Transcription Factor Genes Identified Using BLAST

| Clade Identifier (SEQ ID NO:) | Clade Identifier (GID) | AGI Identifier for Clade Identifier | UniGene Identifier | Species | p-Value |
|---|---|---|---|---|---|
| 425 | G545 | AT1G27730 | Ta_S66284 | *Triticum aestivum* | 5.00E−35 |
| 425 | G545 | AT1G27730 | Vvi_S15355617 | *Vitis vinifera* | 1.00E−52 |
| 425 | G545 | AT1G27730 | Vvi_S15382170 | *Vitis vinifera* | 7.00E−47 |
| 425 | G545 | AT1G27730 | Zm_S11441492 | *Zea mays* | 7.00E−30 |
| 425 | G545 | AT1G27730 | Zm_S11443346 | *Zea mays* | 1.00E−34 |
| 425 | G545 | AT1G27730 | Zm_S11465527 | *Zea mays* | 2.00E−18 |
| 493 | G590 | AT4G36930 | SGN-UNIGENE-47483 | *Lycopersicon esculentum* | 2.00E−34 |
| 493 | G590 | AT4G36930 | SGN-UNIGENE-47925 | *Lycopersicon esculentum* | 2.00E−41 |
| 495 | G602 | AT2G45820 | Gma_S4863794 | *Glycine max* | 5.00E−55 |
| 495 | G602 | AT2G45820 | SGN-UNIGENE-SINGLET-2565 | *Lycopersicon esculentum* | 5.00E−04 |
| 495 | G602 | AT2G45820 | Mtr_S5431439 | *Medicago truncatula* | 3.00E−37 |
| 495 | G602 | AT2G45820 | Pta_S16797626 | *Pinus taeda* | 4.00E−46 |
| 495 | G602 | AT2G45820 | Vvi_S15353882 | *Vitis vinifera* | 4.00E−63 |
| 495 | G602 | AT2G45820 | Zm_S11527752 | *Zea mays* | 5.00E−57 |
| 497 | G618 | AT1G53230 | Gma_S5029115 | *Glycine max* | 9.00E−30 |
| 497 | G618 | AT1G53230 | Les_S5295478 | *Lycopersicon esculentum* | 1.00E−95 |
| 497 | G618 | AT1G53230 | SGN-UNIGENE-50577 | *Lycopersicon esculentum* | 1.00E−52 |
| 497 | G618 | AT1G53230 | SGN-UNIGENE-58580 | *Lycopersicon esculentum* | 1.00E−41 |
| 497 | G618 | AT1G53230 | SGN-UNIGENE-SINGLET-24189 | *Lycopersicon esculentum* | 1.00E−21 |
| 497 | G618 | AT1G53230 | SGN-UNIGENE-SINGLET-394109 | *Lycopersicon esculentum* | 8.00E−30 |
| 497 | G618 | AT1G53230 | SGN-UNIGENE-SINGLET-401522 | *Lycopersicon esculentum* | 2.00E−40 |
| 497 | G618 | AT1G53230 | Os_S113396 | *Oryza sativa* | 1.00E−48 |
| 497 | G618 | AT1G53230 | Os_S113398 | *Oryza sativa* | 1.00E−78 |
| 499 | G635 | AT5G63430 | Mtr_S5399163 | *Medicago truncatula* | 1.00E−40 |
| 499 | G635 | AT5G63430 | Ta_S2764 | *Triticum aestivum* | 6.00E−24 |
| 501 | G643 | AT4G31270 | SGN-UNIGENE-56459 | *Lycopersicon esculentum* | 1.00E−32 |
| 503 | G653 | AT2G39900 | Hv_S136844 | *Hordeum vulgare* | 1.00E−72 |
| 503 | G653 | AT2G39900 | SGN-UNIGENE-46400 | *Lycopersicon esculentum* | 4.00E−93 |
| 503 | G653 | AT2G39900 | SGN-UNIGENE-SINGLET-64524 | *Lycopersicon esculentum* | 2.00E−12 |
| 503 | G653 | AT2G39900 | Mtr_S7091176 | *Medicago truncatula* | 3.00E−51 |
| 503 | G653 | AT2G39900 | Os_S76089 | *Oryza sativa* | 1.00E−37 |
| 503 | G653 | AT2G39900 | Pta_S16790444 | *Pinus taeda* | 1.00E−40 |
| 503 | G653 | AT2G39900 | Pta_S17050802 | *Pinus taeda* | 2.00E−14 |
| 503 | G653 | AT2G39900 | Ta_S166473 | *Triticum aestivum* | 5.00E−71 |
| 503 | G653 | AT2G39900 | Vvi_S15426604 | *Vitis vinifera* | 2.00E−94 |
| 503 | G653 | AT2G39900 | Zm_S11528938 | *Zea mays* | 7.00E−81 |
| 427 | G760 | AT5G04410 | Gma_S4883349 | *Glycine max* | 3.00E−09 |
| 427 | G760 | AT5G04410 | SGN-UNIGENE-47781 | *Lycopersicon esculentum* | 1.00E−106 |
| 427 | G760 | AT5G04410 | SGN-UNIGENE-52634 | *Lycopersicon esculentum* | 6.00E−65 |
| 427 | G760 | AT5G04410 | SGN-UNIGENE-53754 | *Lycopersicon esculentum* | 4.00E−72 |
| 427 | G760 | AT5G04410 | SGN-UNIGENE-SINGLET-23750 | *Lycopersicon esculentum* | 5.00E−29 |
| 427 | G760 | AT5G04410 | SGN-UNIGENE-SINGLET-310313 | *Lycopersicon esculentum* | 1.00E−07 |
| 427 | G760 | AT5G04410 | SGN-UNIGENE-SINGLET-447414 | *Lycopersicon esculentum* | 3.00E−12 |
| 427 | G760 | AT5G04410 | Mtr_S5340844 | *Medicago truncatula* | 6.00E−06 |
| 427 | G760 | AT5G04410 | Mtr_S7090764 | *Medicago truncatula* | 2.00E−14 |
| 427 | G760 | AT5G04410 | Pta_S16789085 | *Pinus taeda* | 7.00E−36 |
| 427 | G760 | AT5G04410 | Ta_S202572 | *Triticum aestivum* | 5.00E−37 |
| 427 | G760 | AT5G04410 | Vvi_S16873427 | *Vitis vinifera* | 4.00E−21 |
| 427 | G760 | AT5G04410 | Zm_S11526816 | *Zea mays* | 1.00E−16 |
| 427 | G760 | AT5G04410 | Zm_S11529038 | *Zea mays* | 1.00E−45 |
| 429 | G773 | AT3G15500 | Gma_S5050636 | *Glycine max* | 5.00E−84 |
| 429 | G773 | AT3G15500 | Les_S5295623 | *Lycopersicon esculentum* | 1.00E−105 |
| 429 | G773 | AT3G15500 | SGN-UNIGENE-45948 | *Lycopersicon esculentum* | 1.00E−105 |
| 429 | G773 | AT3G15500 | SGN-UNIGENE-48215 | *Lycopersicon esculentum* | 1.00E−105 |
| 507 | G837 | AT1G29470 | Gma_S4898629 | *Glycine max* | 1.00E−93 |
| 507 | G837 | AT1G29470 | Gma_S4907362 | *Glycine max* | 1.00E−16 |
| 507 | G837 | AT1G29470 | Hv_S8292 | *Hordeum vulgare* | 2.00E−71 |
| 507 | G837 | AT1G29470 | SGN-UNIGENE-47489 | *Lycopersicon esculentum* | 1.0e−999 |
| 507 | G837 | AT1G29470 | SGN-UNIGENE-47510 | *Lycopersicon esculentum* | 1.00E−121 |
| 507 | G837 | AT1G29470 | SGN-UNIGENE-51256 | *Lycopersicon esculentum* | 1.00E−142 |
| 507 | G837 | AT1G29470 | SGN-UNIGENE-56050 | *Lycopersicon esculentum* | 2.00E−54 |
| 507 | G837 | AT1G29470 | Mtr_S10821012 | *Medicago truncatula* | 1.00E−117 |
| 507 | G837 | AT1G29470 | Pta_S15736214 | *Pinus taeda* | 1.00E−48 |
| 507 | G837 | AT1G29470 | Pta_S15776645 | *Pinus taeda* | 1.00E−74 |
| 507 | G837 | AT1G29470 | Vvi_S15426449 | *Vitis vinifera* | 1.00E−118 |

TABLE 8-continued

Orthologs of Representative *Arabidopsis* Transcription Factor Genes Identified Using BLAST

| Clade Identifier (SEQ ID NO:) | Clade Identifier (GID) | AGI Identifier for Clade Identifier | UniGene Identifier | Species | p-Value |
|---|---|---|---|---|---|
| 507 | G837 | AT1G29470 | Vvi_S16870363 | *Vitis vinifera* | 6.00E−23 |
| 507 | G837 | AT1G29470 | Zm_S11528144 | *Zea mays* | 1.0e−999 |
| 509 | G866 | AT2G24570 | Gma_S4874203 | *Glycine max* | 2.00E−47 |
| 509 | G866 | AT2G24570 | Gma_S4886425 | *Glycine max* | 5.00E−19 |
| 509 | G866 | AT2G24570 | Gma_S5106568 | *Glycine max* | 2.00E−53 |
| 509 | G866 | AT2G24570 | Les_S6657761 | *Lycopersicon esculentum* | 2.00E−19 |
| 509 | G866 | AT2G24570 | Les_S6657762 | *Lycopersicon esculentum* | 2.00E−16 |
| 509 | G866 | AT2G24570 | SGN-UNIGENE-45903 | *Lycopersicon esculentum* | 2.00E−86 |
| 509 | G866 | AT2G24570 | SGN-UNIGENE-SINGLET-439904 | *Lycopersicon esculentum* | 1.00E−26 |
| 509 | G866 | AT2G24570 | Mtr_S5305224 | *Medicago truncatula* | 2.00E−44 |
| 509 | G866 | AT2G24570 | Mtr_S7091692 | *Medicago truncatula* | 1.00E−66 |
| 509 | G866 | AT2G24570 | Os_S44434 | *Oryza sativa* | 8.00E−42 |
| 509 | G866 | AT2G24570 | Ta_S174179 | *Triticum aestivum* | 8.00E−46 |
| 509 | G866 | AT2G24570 | Ta_S280279 | *Triticum aestivum* | 1.00E−27 |
| 509 | G866 | AT2G24570 | Vvi_S15374416 | *Vitis vinifera* | 9.00E−39 |
| 509 | G866 | AT2G24570 | Zm_S11523935 | *Zea mays* | 1.00E−75 |
| 511 | G872 | AT1G74930 | SGN-UNIGENE-50296 | *Lycopersicon esculentum* | 7.00E−44 |
| 511 | G872 | AT1G74930 | Pta_S15754706 | *Pinus taeda* | 7.00E−25 |
| 511 | G872 | AT1G74930 | Pta_S15767728 | *Pinus taeda* | 2.00E−29 |
| 511 | G872 | AT1G74930 | Pta_S15779272 | *Pinus taeda* | 2.00E−28 |
| 511 | G872 | AT1G74930 | Vvi_S16870232 | *Vitis vinifera* | 1.00E−15 |
| 515 | G912 | AT5G51990 | Hv_S152300 | *Hordeum vulgare* | 2.00E−46 |
| 515 | G912 | AT5G51990 | Hv_S158942 | *Hordeum vulgare* | 3.00E−33 |
| 515 | G912 | AT5G51990 | Hv_S74288 | *Hordeum vulgare* | 4.00E−36 |
| 515 | G912 | AT5G51990 | Hv_S74289 | *Hordeum vulgare* | 4.00E−35 |
| 515 | G912 | AT5G51990 | Les_S5295301 | *Lycopersicon esculentum* | 6.00E−61 |
| 515 | G912 | AT5G51990 | SGN-UNIGENE-46974 | *Lycopersicon esculentum* | 4.00E−50 |
| 515 | G912 | AT5G51990 | SGN-UNIGENE-46975 | *Lycopersicon esculentum* | 2.00E−56 |
| 515 | G912 | AT5G51990 | SGN-UNIGENE-58571 | *Lycopersicon esculentum* | 8.00E−47 |
| 515 | G912 | AT5G51990 | SGN-UNIGENE-SINGLET-398604 | *Lycopersicon esculentum* | 3.00E−35 |
| 515 | G912 | AT5G51990 | Os_S116938 | *Oryza sativa* | 1.00E−36 |
| 515 | G912 | AT5G51990 | Os_S116940 | *Oryza sativa* | 9.00E−33 |
| 515 | G912 | AT5G51990 | Os_S117813 | *Oryza sativa* | 3.00E−44 |
| 515 | G912 | AT5G51990 | Os_S65912 | *Oryza sativa* | 5.00E−25 |
| 515 | G912 | AT5G51990 | Ta_S47586 | *Triticum aestivum* | 2.00E−20 |
| 515 | G912 | AT5G51990 | Ta_S75229 | *Triticum aestivum* | 2.00E−33 |
| 515 | G912 | AT5G51990 | Vvi_S15357313 | *Vitis vinifera* | 7.00E−09 |
| 515 | G912 | AT5G51990 | Vvi_S15391707 | *Vitis vinifera* | 1.00E−41 |
| 515 | G912 | AT5G51990 | Zm_S11519368 | *Zea mays* | 3.00E−31 |
| 517 | G932 | AT3G47600 | Les_S5295595 | *Lycopersicon esculentum* | 7.00E−82 |
| 517 | G932 | AT3G47600 | SGN-UNIGENE-52504 | *Lycopersicon esculentum* | 7.00E−81 |
| 517 | G932 | AT3G47600 | SGN-UNIGENE-52540 | *Lycopersicon esculentum* | 1.00E−46 |
| 517 | G932 | AT3G47600 | SGN-UNIGENE-57232 | *Lycopersicon esculentum* | 6.00E−68 |
| 517 | G932 | AT3G47600 | Vvi_S16532074 | *Vitis vinifera* | 2.00E−87 |
| 517 | G932 | AT3G47600 | Zm_S11524655 | *Zea mays* | 4.00E−80 |
| 517 | G932 | AT3G47600 | Zm_S11529150 | *Zea mays* | 7.00E−18 |
| 517 | G932 | AT3G47600 | Zm_S11529161 | *Zea mays* | 8.00E−16 |
| 517 | G932 | AT3G47600 | Zm_S11529174 | *Zea mays* | 3.00E−15 |
| 517 | G932 | AT3G47600 | Zm_S11529193 | *Zea mays* | 9.00E−18 |
| 431 | G937 | AT1G49560 | Gma_S5129137 | *Glycine max* | 4.00E−20 |
| 431 | G937 | AT1G49560 | Vvi_S15431951 | *Vitis vinifera* | 2.00E−39 |
| 431 | G937 | AT1G49560 | Vvi_S16805106 | *Vitis vinifera* | 1.00E−16 |
| 519 | G958 | AT1G65910 | Os_S61189 | *Oryza sativa* | 3.00E−55 |
| 519 | G958 | AT1G65910 | Os_S69951 | *Oryza sativa* | 8.00E−10 |
| 519 | G958 | AT1G65910 | Pta_S15738910 | *Pinus taeda* | 4.00E−10 |
| 519 | G958 | AT1G65910 | Pta_S15774939 | *Pinus taeda* | 2.00E−33 |
| 519 | G958 | AT1G65910 | Zm_S11437468 | *Zea mays* | 4.00E−19 |
| 521 | G964 | AT5G47370 | Gma_S5001940 | *Glycine max* | 3.00E−04 |
| 521 | G964 | AT5G47370 | Pta_S15797996 | *Pinus taeda* | 1.00E−38 |
| 237 | G975 | AT1G15360 | SGN-UNIGENE-SINGLET-14957 | *Lycopersicon esculentum* | 2.00E−52 |
| 237 | G975 | AT1G15360 | SGN-UNIGENE-SINGLET-335836 | *Lycopersicon esculentum* | 9.00E−59 |
| 523 | G979 | AT3G54320 | SGN-UNIGENE-SINGLET-517 | *Lycopersicon esculentum* | 5.00E−74 |
| 523 | G979 | AT3G54320 | Zm_S11528772 | *Zea mays* | 3.00E−77 |
| 435 | G988 | AT1G55580 | Les_S5295726 | *Lycopersicon esculentum* | 1.00E−114 |
| 525 | G1049 | AT3G30530 | Gma_S5131758 | *Glycine max* | 2.00E−30 |
| 525 | G1049 | AT3G30530 | SGN-UNIGENE-SINGLET-333614 | *Lycopersicon esculentum* | 5.00E−38 |

TABLE 8-continued

Orthologs of Representative *Arabidopsis* Transcription Factor Genes Identified Using BLAST

| Clade Identifier (SEQ ID NO:) | Clade Identifier (GID) | AGI Identifier for Clade Identifier | UniGene Identifier | Species | p-Value |
|---|---|---|---|---|---|
| 525 | G1049 | AT3G30530 | Zm_S11445843 | *Zea mays* | 1.00E−17 |
| 239 | G1069 | AT4G14465 | SGN-UNIGENE-59076 | *Lycopersicon esculentum* | 6.00E−55 |
| 239 | G1069 | AT4G14465 | Vvi_S16805621 | *Vitis vinifera* | 1.00E−04 |
| 439 | G1090 | AT1G33760 | SGN-UNIGENE-54402 | *Lycopersicon esculentum* | 3.00E−40 |
| 529 | G1255 | AT1G25440 | SGN-UNIGENE-48698 | *Lycopersicon esculentum* | 5.00E−55 |
| 529 | G1255 | AT1G25440 | SGN-UNIGENE-53476 | *Lycopersicon esculentum* | 1.00E−41 |
| 529 | G1255 | AT1G25440 | SGN-UNIGENE-54828 | *Lycopersicon esculentum* | 9.00E−37 |
| 529 | G1255 | AT1G25440 | Mtr_S5409553 | *Medicago truncatula* | 1.00E−17 |
| 529 | G1255 | AT1G25440 | Ta_S203158 | *Triticum aestivum* | 5.00E−19 |
| 529 | G1255 | AT1G25440 | Ta_S363550 | *Triticum aestivum* | 2.00E−21 |
| 529 | G1255 | AT1G25440 | Vvi_S15427527 | *Vitis vinifera* | 4.00E−24 |
| 529 | G1255 | AT1G25440 | Vvi_S15431583 | *Vitis vinifera* | 1.00E−24 |
| 529 | G1255 | AT1G25440 | Zm_S11485770 | *Zea mays* | 1.00E−26 |
| 531 | G1266 | AT3G23240 | Les_S5269007 | *Lycopersicon esculentum* | 2.00E−18 |
| 531 | G1266 | AT3G23240 | Les_S5295266 | *Lycopersicon esculentum* | 2.00E−37 |
| 531 | G1266 | AT3G23240 | Les_S5295755 | *Lycopersicon esculentum* | 8.00E−30 |
| 531 | G1266 | AT3G23240 | Les_S6682822 | *Lycopersicon esculentum* | 8.00E−56 |
| 531 | G1266 | AT3G23240 | SGN-UNIGENE-48067 | *Lycopersicon esculentum* | 3.00E−38 |
| 531 | G1266 | AT3G23240 | SGN-UNIGENE-49923 | *Lycopersicon esculentum* | 9.00E−30 |
| 531 | G1266 | AT3G23240 | SGN-UNIGENE-52630 | *Lycopersicon esculentum* | 2.00E−37 |
| 531 | G1266 | AT3G23240 | SGN-UNIGENE-SINGLET-38956 | *Lycopersicon esculentum* | 6.00E−19 |
| 441 | G1322 | AT3G01530 | Gma_S4904682 | *Glycine max* | 1.00E−17 |
| 441 | G1322 | AT3G01530 | SGN-UNIGENE-58620 | *Lycopersicon esculentum* | 7.00E−67 |
| 441 | G1322 | AT3G01530 | SGN-UNIGENE-SINGLET-16950 | *Lycopersicon esculentum* | 4.00E−42 |
| 441 | G1322 | AT3G01530 | Vvi_S15388842 | *Vitis vinifera* | 4.00E−48 |
| 441 | G1322 | AT3G01530 | Zm_S11529147 | *Zea mays* | 9.00E−13 |
| 533 | G1331 | AT4G13480 | Zm_S11529198 | *Zea mays* | 7.00E−18 |
| 537 | G1494 | AT2G43010 | Vvi_S16871195 | *Vitis vinifera* | 4.00E−46 |
| 539 | G1535 | AT5G46880 | SGN-UNIGENE-SINGLET-13754 | *Lycopersicon esculentum* | 4.00E−70 |
| 539 | G1535 | AT5G46880 | Os_S98061 | *Oryza sativa* | 9.00E−11 |
| 539 | G1535 | AT5G46880 | Zm_S11418454 | *Zea mays* | 1.00E−180 |
| 539 | G1535 | AT5G46880 | Zm_S11522858 | *Zea mays* | 1.00E−155 |
| 445 | G1666 | AT4G09820 | Pta_S17046663 | *Pinus taeda* | 7.00E−21 |
| 543 | G1750 | AT4G27950 | Les_S5295754 | *Lycopersicon esculentum* | 9.00E−38 |
| 543 | G1750 | AT4G27950 | SGN-UNIGENE-49801 | *Lycopersicon esculentum* | 9.00E−19 |
| 543 | G1750 | AT4G27950 | SGN-UNIGENE-SINGLET-2078 | *Lycopersicon esculentum* | 1.00E−10 |
| 543 | G1750 | AT4G27950 | SGN-UNIGENE-SINGLET-446513 | *Lycopersicon esculentum* | 3.00E−28 |
| 547 | G1835 | AT3G54810 | Gma_S4889036 | *Glycine max* | 2.00E−33 |
| 547 | G1835 | AT3G54810 | Gma_S4911179 | *Glycine max* | 2.00E−11 |
| 547 | G1835 | AT3G54810 | SGN-UNIGENE-48476 | *Lycopersicon esculentum* | 1.00E−54 |
| 547 | G1835 | AT3G54810 | SGN-UNIGENE-51325 | *Lycopersicon esculentum* | 4.00E−25 |
| 547 | G1835 | AT3G54810 | Ta_S142289 | *Triticum aestivum* | 2.00E−25 |
| 547 | G1835 | AT3G54810 | Ta_S266353 | *Triticum aestivum* | 1.00E−31 |
| 547 | G1835 | AT3G54810 | Vvi_S16865934 | *Vitis vinifera* | 1.00E−36 |
| 451 | G1868 | AT4G37740 | SGN-UNIGENE-48848 | *Lycopersicon esculentum* | 4.00E−82 |
| 451 | G1868 | AT4G37740 | SGN-UNIGENE-SINGLET-453383 | *Lycopersicon esculentum* | 5.00E−25 |
| 451 | G1868 | AT4G37740 | Os_S96499 | *Oryza sativa* | 7.00E−04 |
| 451 | G1868 | AT4G37740 | Pta_S16800293 | *Pinus taeda* | 2.00E−08 |
| 451 | G1868 | AT4G37740 | Ta_S178842 | *Triticum aestivum* | 3.00E−11 |
| 451 | G1868 | AT4G37740 | Zm_S11522646 | *Zea mays* | 2.00E−14 |
| 451 | G1868 | AT4G37740 | Zm_S11522707 | *Zea mays* | 9.00E−11 |
| 451 | G1868 | AT4G37740 | Zm_S11525236 | *Zea mays* | 2.00E−21 |
| 453 | G1888 | AT4G39070 | SGN-UNIGENE-47593 | *Lycopersicon esculentum* | 7.00E−60 |
| 453 | G1888 | AT4G39070 | Mtr_S10820905 | *Medicago truncatula* | 2.00E−48 |
| 453 | G1888 | AT4G39070 | Os_S60490 | *Oryza sativa* | 6.00E−45 |
| 453 | G1888 | AT4G39070 | Zm_S11432778 | *Zea mays* | 3.00E−19 |
| 549 | G1930 | AT3G25730 | SGN-UNIGENE-47598 | *Lycopersicon esculentum* | 3.00E−52 |
| 549 | G1930 | AT3G25730 | SGN-UNIGENE-SINGLET-393621 | *Lycopersicon esculentum* | 5.00E−57 |
| 549 | G1930 | AT3G25730 | SGN-UNIGENE-SINGLET-44327 | *Lycopersicon esculentum* | 6.00E−27 |
| 549 | G1930 | AT3G25730 | Mtr_S5430627 | *Medicago truncatula* | 1.00E−63 |
| 549 | G1930 | AT3G25730 | Os_S75175 | *Oryza sativa* | 3.00E−17 |
| 549 | G1930 | AT3G25730 | Zm_S11506592 | *Zea mays* | 1.00E−37 |
| 551 | G2057 | AT3G15030 | Gma_S5029115 | *Glycine max* | 9.00E−30 |
| 551 | G2057 | AT3G15030 | Les_S5295478 | *Lycopersicon esculentum* | 1.00E−95 |
| 551 | G2057 | AT3G15030 | SGN-UNIGENE-50577 | *Lycopersicon esculentum* | 1.00E−52 |

TABLE 8-continued

Orthologs of Representative *Arabidopsis* Transcription Factor Genes Identified Using BLAST

| Clade Identifier (SEQ ID NO:) | Clade Identifier (GID) | AGI Identifier for Clade Identifier | UniGene Identifier | Species | p-Value |
|---|---|---|---|---|---|
| 551 | G2057 | AT3G15030 | SGN-UNIGENE-58580 | *Lycopersicon esculentum* | 1.00E−41 |
| 551 | G2057 | AT3G15030 | SGN-UNIGENE-SINGLET-24189 | *Lycopersicon esculentum* | 1.00E−21 |
| 551 | G2057 | AT3G15030 | SGN-UNIGENE-SINGLET-394109 | *Lycopersicon esculentum* | 8.00E−30 |
| 551 | G2057 | AT3G15030 | SGN-UNIGENE-SINGLET-401522 | *Lycopersicon esculentum* | 2.00E−40 |
| 551 | G2057 | AT3G15030 | Os_S113396 | *Oryza sativa* | 1.00E−48 |
| 551 | G2057 | AT3G15030 | Os_S113398 | *Oryza sativa* | 1.00E−78 |
| 457 | G2131 | AT1G79700 | SGN-UNIGENE-SINGLET-517 | *Lycopersicon esculentum* | 5.00E−74 |
| 457 | G2131 | AT1G79700 | Zm_S11528772 | *Zea mays* | 3.00E−77 |
| 553 | G2144 | AT3G57800 | SGN-UNIGENE-51335 | *Lycopersicon esculentum* | 1.00E−21 |
| 553 | G2144 | AT3G57800 | Vvi_S16529913 | *Vitis vinifera* | 3.00E−39 |
| 555 | G2145 | AT1G27740 | Ta_S174040 | *Triticum aestivum* | 3.00E−40 |
| 559 | G2512 | AT1G06160 | Hv_S20601 | *Hordeum vulgare* | 9.00E−15 |
| 559 | G2512 | AT1G06160 | SGN-UNIGENE-SINGLET-2865 | *Lycopersicon esculentum* | 6.00E−24 |
| 459 | G2520 | AT1G59640 | Gma_S5045510 | *Glycine max* | 2.00E−46 |
| 459 | G2520 | AT1G59640 | Les_S5183164 | *Lycopersicon esculentum* | 1.00E−55 |
| 459 | G2520 | AT1G59640 | Les_S5203454 | *Lycopersicon esculentum* | 1.00E−44 |
| 459 | G2520 | AT1G59640 | SGN-UNIGENE-44928 | *Lycopersicon esculentum* | 4.00E−72 |
| 459 | G2520 | AT1G59640 | Ta_S84222 | *Triticum aestivum* | 3.00E−38 |
| 459 | G2520 | AT1G59640 | Vvi_S15421316 | *Vitis vinifera* | 7.00E−07 |
| 459 | G2520 | AT1G59640 | Vvi_S16529182 | *Vitis vinifera* | 6.00E−61 |
| 459 | G2520 | AT1G59640 | Zm_S11524369 | *Zea mays* | 1.00E−40 |
| 461 | G2522 | AT3G61310 | Gma_S4864518 | *Glycine max* | 5.00E−24 |
| 461 | G2522 | AT3G61310 | Hv_S36040 | *Hordeum vulgare* | 4.00E−35 |
| 461 | G2522 | AT3G61310 | SGN-UNIGENE-50326 | *Lycopersicon esculentum* | 6.00E−40 |
| 461 | G2522 | AT3G61310 | Pta_S15767209 | *Pinus taeda* | 3.00E−17 |
| 461 | G2522 | AT3G61310 | Ta_S115031 | *Triticum aestivum* | 9.00E−09 |
| 461 | G2522 | AT3G61310 | Ta_S65435 | *Triticum aestivum* | 4.00E−48 |
| 461 | G2522 | AT3G61310 | Vvi_S15370801 | *Vitis vinifera* | 1.00E−55 |
| 563 | G2535 | AT3G61910 | Gma_S5137324 | *Glycine max* | 4.00E−12 |
| 563 | G2535 | AT3G61910 | SGN-UNIGENE-SINGLET-366637 | *Lycopersicon esculentum* | 1.00E−72 |
| 567 | G2719 | AT3G55730 | SGN-UNIGENE-SINGLET-357168 | *Lycopersicon esculentum* | 5.00E−52 |
| 567 | G2789 | AT3G60870 | Gma_S4935598 | *Glycine max* | 2.00E−67 |
| 247 | G2789 | AT3G60870 | Pta_S15799222 | *Pinus taeda* | 6.00E−43 |
| 247 | G2789 | AT3G60870 | Pta_S16786360 | *Pinus taeda* | 2.00E−70 |
| 247 | G2789 | AT3G60870 | Pta_S16788492 | *Pinus taeda* | 7.00E−63 |
| 247 | G2789 | AT3G60870 | Pta_S16802054 | *Pinus taeda* | 1.00E−57 |
| 423 | G38 | AT5G05410 | Gma_S4861946 | *Glycine max* | 6.00E−42 |
| 423 | G38 | AT5G05410 | Hv_S230730 | *Hordeum vulgare* | 4.00E−47 |
| 423 | G38 | AT5G05410 | Hv_S230731 | *Hordeum vulgare* | 3.00E−44 |
| 423 | G38 | AT5G05410 | Les_S6682824 | *Lycopersicon esculentum* | 2.00E−52 |
| 423 | G38 | AT5G05410 | Os_S116939 | *Oryza sativa* | 9.00E−45 |
| 423 | G38 | AT5G05410 | Ta_S266443 | *Triticum aestivum* | 9.00E−42 |
| 423 | G38 | AT5G05410 | Zm_S11524426 | *Zea mays* | 4.00E−41 |
| 827 | G44 | AT5G61600 | Vvi_S15378188 | *Vitis vinifera* | 1.00E−04 |
| 827 | G44 | AT5G61600 | Vvi_S15402707 | *Vitis vinifera* | 4.00E−42 |
| 827 | G44 | AT5G61600 | Vvi_S16082016 | *Vitis vinifera* | 1.00E−41 |
| 829 | G230 | AT2G23290 | Gma_S4873244 | *Glycine max* | 8.00E−08 |
| 829 | G230 | AT2G23290 | Gma_S4897857 | *Glycine max* | 2.00E−69 |
| 829 | G230 | AT2G23290 | SGN-UNIGENE-46140 | *Lycopersicon esculentum* | 1.00E−79 |
| 829 | G230 | AT2G23290 | SGN-UNIGENE-46445 | *Lycopersicon esculentum* | 3.00E−71 |
| 829 | G230 | AT2G23290 | SGN-UNIGENE-SINGLET-396033 | *Lycopersicon esculentum* | 3.00E−45 |
| 829 | G230 | AT2G23290 | Mtr_S5318648 | *Medicago truncatula* | 5.00E−67 |
| 829 | G230 | AT2G23290 | Mtr_S5421663 | *Medicago truncatula* | 1.00E−48 |
| 829 | G230 | AT2G23290 | Mtr_S5454442 | *Medicago truncatula* | 4.00E−09 |
| 829 | G230 | AT2G23290 | Vvi_S15351083 | *Vitis vinifera* | 2.00E−15 |
| 829 | G230 | AT2G23290 | Vvi_S15373434 | *Vitis vinifera* | 4.00E−10 |
| 479 | G234 | AT3G49690 | SGN-UNIGENE-SINGLET-21166 | *Lycopersicon esculentum* | 3.00E−57 |
| 479 | G234 | AT3G49690 | Zm_S11529159 | *Zea mays* | 3.00E−15 |
| 479 | G234 | AT3G49690 | Zm_S11529194 | *Zea mays* | 3.00E−16 |
| 831 | G261 | AT4G18880 | Gma_S5144289 | *Glycine max* | 4.00E−34 |
| 831 | G261 | AT4G18880 | SGN-UNIGENE-51749 | *Lycopersicon esculentum* | 9.00E−76 |
| 831 | G261 | AT4G18880 | SGN-UNIGENE-59194 | *Lycopersicon esculentum* | 3.00E−24 |
| 831 | G261 | AT4G18880 | Mtr_S7091605 | *Medicago truncatula* | 2.00E−50 |
| 831 | G261 | AT4G18880 | Os_S23803 | *Oryza sativa* | 8.00E−12 |

TABLE 8-continued

Orthologs of Representative *Arabidopsis* Transcription Factor Genes Identified Using BLAST

| Clade Identifier (SEQ ID NO:) | Clade Identifier (GID) | AGI Identifier for Clade Identifier | UniGene Identifier | Species | p-Value |
|---|---|---|---|---|---|
| 831 | G261 | AT4G18880 | Os_S83230 | *Oryza sativa* | 1.00E−66 |
| 831 | G261 | AT4G18880 | Pta_S15769714 | *Pinus taeda* | 2.00E−45 |
| 831 | G261 | AT4G18880 | Vvi_S15370308 | *Vitis vinifera* | 5.00E−21 |
| 831 | G261 | AT4G18880 | Vvi_S15413763 | *Vitis vinifera* | 4.00E−08 |
| 831 | G261 | AT4G18880 | Zm_S11521772 | *Zea mays* | 6.00E−26 |
| 839 | G388 | AT1G79840 | SGN-UNIGENE-SINGLET-2889 | *Lycopersicon esculentum* | 3.00E−36 |
| 839 | G388 | AT1G79840 | SGN-UNIGENE-SINGLET-393604 | *Lycopersicon esculentum* | 8.00E−24 |
| 839 | G388 | AT1G79840 | Vvi_S15431305 | *Vitis vinifera* | 3.00E−66 |
| 841 | G435 | AT5G53980 | SGN-UNIGENE-SINGLET-385221 | *Lycopersicon esculentum* | 1.00E−24 |
| 845 | G468 | AT2G46990 | Os_S100653 | *Oryza sativa* | 6.00E−05 |
| 845 | G468 | AT2G46990 | Vvi_S16820866 | *Vitis vinifera* | 5.00E−37 |
| 847 | G571 | AT5G06839 | SGN-UNIGENE-SINGLET-312251 | *Lycopersicon esculentum* | 9.00E−49 |
| 847 | G571 | AT5G06839 | SGN-UNIGENE-SINGLET-39818 | *Lycopersicon esculentum* | 3.00E−56 |
| 231 | G634 | AT1G33240 | Pta_S17050439 | *Pinus taeda* | 3.00E−39 |
| 231 | G634 | AT1G33240 | Zm_S11449298 | *Zea mays* | 3.00E−35 |
| 849 | G652 | AT2G21060 | Gma_S4871214 | *Glycine max* | 2.00E−20 |
| 849 | G652 | AT2G21060 | Gma_S4965905 | *Glycine max* | 3.00E−26 |
| 849 | G652 | AT2G21060 | Gma_S5135351 | *Glycine max* | 1.00E−18 |
| 849 | G652 | AT2G21060 | Hv_S142991 | *Hordeum vulgare* | 6.00E−47 |
| 849 | G652 | AT2G21060 | Hv_S147464 | *Hordeum vulgare* | 1.00E−22 |
| 849 | G652 | AT2G21060 | Les_S5162139 | *Lycopersicon esculentum* | 3.00E−15 |
| 849 | G652 | AT2G21060 | SGN-UNIGENE-56979 | *Lycopersicon esculentum* | 1.00E−40 |
| 849 | G652 | AT2G21060 | Os_S46064 | *Oryza sativa* | 4.00E−36 |
| 849 | G652 | AT2G21060 | Pta_S15741898 | *Pinus taeda* | 7.00E−49 |
| 849 | G652 | AT2G21060 | Ta_S2509 | *Triticum aestivum* | 5.00E−05 |
| 849 | G652 | AT2G21060 | Ta_S45732 | *Triticum aestivum* | 1.00E−22 |
| 849 | G652 | AT2G21060 | Ta_S60357 | *Triticum aestivum* | 6.00E−14 |
| 849 | G652 | AT2G21060 | Ta_S75244 | *Triticum aestivum* | 3.00E−66 |
| 849 | G652 | AT2G21060 | Vvi_S16864906 | *Vitis vinifera* | 5.00E−16 |
| 849 | G652 | AT2G21060 | Vvi_S16965349 | *Vitis vinifera* | 1.00E−18 |
| 849 | G652 | AT2G21060 | Zm_S11487070 | *Zea mays* | 1.00E−51 |
| 851 | G664 | AT4G38620 | Gma_S4875209 | *Glycine max* | 6.00E−71 |
| 851 | G664 | AT4G38620 | Gma_S5069370 | *Glycine max* | 3.00E−78 |
| 851 | G664 | AT4G38620 | Hv_S73887 | *Hordeum vulgare* | 3.00E−77 |
| 851 | G664 | AT4G38620 | Hv_S73888 | *Hordeum vulgare* | 3.00E−71 |
| 851 | G664 | AT4G38620 | Les_S5295913 | *Lycopersicon esculentum* | 1.00E−89 |
| 851 | G664 | AT4G38620 | SGN-UNIGENE-48139 | *Lycopersicon esculentum* | 1.00E−89 |
| 851 | G664 | AT4G38620 | SGN-UNIGENE-52314 | *Lycopersicon esculentum* | 3.00E−76 |
| 851 | G664 | AT4G38620 | SGN-UNIGENE-58669 | *Lycopersicon esculentum* | 5.00E−49 |
| 851 | G664 | AT4G38620 | SGN-UNIGENE-SINGLET-56292 | *Lycopersicon esculentum* | 3.00E−04 |
| 851 | G664 | AT4G38620 | Mtr_S5321074 | *Medicago truncatula* | 2.00E−76 |
| 851 | G664 | AT4G38620 | Mtr_S5436024 | *Medicago truncatula* | 1.00E−38 |
| 851 | G664 | AT4G38620 | Os_S60586 | *Oryza sativa* | 7.00E−67 |
| 851 | G664 | AT4G38620 | Os_S96599 | *Oryza sativa* | 4.00E−06 |
| 851 | G664 | AT4G38620 | Pta_S15736913 | *Pinus taeda* | 7.00E−65 |
| 851 | G664 | AT4G38620 | Pta_S16787963 | *Pinus taeda* | 3.00E−74 |
| 851 | G664 | AT4G38620 | Pta_S16796777 | *Pinus taeda* | 7.00E−16 |
| 851 | G664 | AT4G38620 | Pta_S16796852 | *Pinus taeda* | 4.00E−52 |
| 851 | G664 | AT4G38620 | Pta_S16800437 | *Pinus taeda* | 1.00E−21 |
| 851 | G664 | AT4G38620 | Pta_S16802819 | *Pinus taeda* | 2.00E−66 |
| 851 | G664 | AT4G38620 | Pta_S17046107 | *Pinus taeda* | 1.00E−64 |
| 851 | G664 | AT4G38620 | Pta_S17052332 | *Pinus taeda* | 6.00E−29 |
| 851 | G664 | AT4G38620 | Ta_S207746 | *Triticum aestivum* | 2.00E−73 |
| 851 | G664 | AT4G38620 | Vvi_S15352484 | *Vitis vinifera* | 1.00E−10 |
| 851 | G664 | AT4G38620 | Vvi_S15427762 | *Vitis vinifera* | 3.00E−88 |
| 851 | G664 | AT4G38620 | Zm_S11519370 | *Zea mays* | 2.00E−46 |
| 851 | G664 | AT4G38620 | Zm_S11521958 | *Zea mays* | 1.00E−73 |
| 851 | G664 | AT4G38620 | Zm_S11524344 | *Zea mays* | 1.00E−79 |
| 851 | G664 | AT4G38620 | Zm_S11529167 | *Zea mays* | 2.00E−18 |
| 851 | G664 | AT4G38620 | Zm_S11529181 | *Zea mays* | 5.00E−18 |
| 853 | G772 | AT3G10480 | Gma_S5023840 | *Glycine max* | 1.00E−25 |
| 853 | G772 | AT3G10480 | SGN-UNIGENE-49809 | *Lycopersicon esculentum* | 2.00E−87 |
| 853 | G772 | AT3G10480 | Mtr_S5395615 | *Medicago truncatula* | 4.00E−10 |
| 855 | G798 | AT3G50410 | Mtr_S5415694 | *Medicago truncatula* | 2.00E−15 |
| 859 | G974 | AT1G22190 | Gma_S4897318 | *Glycine max* | 3.00E−18 |
| 859 | G974 | AT1G22190 | Gma_S4897472 | *Glycine max* | 3.00E−30 |
| 859 | G974 | AT1G22190 | Gma_S4898590 | *Glycine max* | 2.00E−57 |

TABLE 8-continued

Orthologs of Representative *Arabidopsis* Transcription Factor Genes Identified Using BLAST

| Clade Identifier (SEQ ID NO:) | Clade Identifier (GID) | AGI Identifier for Clade Identifier | UniGene Identifier | Species | p-Value |
|---|---|---|---|---|---|
| 859 | G974 | AT1G22190 | Hv_S10412 | *Hordeum vulgare* | 2.00E−08 |
| 859 | G974 | AT1G22190 | Hv_S70023 | *Hordeum vulgare* | 1.00E−14 |
| 859 | G974 | AT1G22190 | Les_S5182292 | *Lycopersicon esculentum* | 4.00E−60 |
| 859 | G974 | AT1G22190 | SGN-UNIGENE-44095 | *Lycopersicon esculentum* | 4.00E−76 |
| 859 | G974 | AT1G22190 | SGN-UNIGENE-44231 | *Lycopersicon esculentum* | 1.00E−68 |
| 859 | G974 | AT1G22190 | Mtr_S7093809 | *Medicago truncatula* | 4.00E−28 |
| 859 | G974 | AT1G22190 | Os_S37084 | *Oryza sativa* | 2.00E−05 |
| 859 | G974 | AT1G22190 | Pta_S16845578 | *Pinus taeda* | 3.00E−26 |
| 859 | G974 | AT1G22190 | Ta_S120947 | *Triticum aestivum* | 5.00E−11 |
| 859 | G974 | AT1G22190 | Ta_S184473 | *Triticum aestivum* | 1.00E−17 |
| 859 | G974 | AT1G22190 | Ta_S278378 | *Triticum aestivum* | 1.00E−09 |
| 859 | G974 | AT1G22190 | Vvi_S15351270 | *Vitis vinifera* | 3.00E−39 |
| 859 | G974 | AT1G22190 | Vvi_S15407610 | *Vitis vinifera* | 1.00E−60 |
| 859 | G974 | AT1G22190 | Zm_S11323940 | *Zea mays* | 2.00E−29 |
| 859 | G974 | AT1G22190 | Zm_S11490783 | *Zea mays* | 2.00E−45 |
| 859 | G974 | AT1G22190 | Zm_S11528582 | *Zea mays* | 1.00E−44 |
| 435 | G988 | AT1G55580 | Les_S5295726 | *Lycopersicon esculentum* | 1.00E−114 |
| 807 | G1048 | AT1G42990 | Gma_S4871472 | *Glycine max* | 3.00E−07 |
| 807 | G1048 | AT1G42990 | SGN-UNIGENE-45931 | *Lycopersicon esculentum* | 2.00E−38 |
| 807 | G1048 | AT1G42990 | Mtr_S5316975 | *Medicago truncatula* | 7.00E−29 |
| 807 | G1048 | AT1G42990 | Ta_S244122 | *Triticum aestivum* | 3.00E−18 |
| 807 | G1048 | AT1G42990 | Vvi_S15353884 | *Vitis vinifera* | 4.00E−30 |
| 807 | G1048 | AT1G42990 | Zm_S11527760 | *Zea mays* | 1.00E−24 |
| 861 | G1062 | AT3G26744 | Gma_S4932282 | *Glycine max* | 5.00E−43 |
| 861 | G1062 | AT3G26744 | Les_S5250575 | *Lycopersicon esculentum* | 5.00E−70 |
| 861 | G1062 | AT3G26744 | SGN-UNIGENE-45946 | *Lycopersicon esculentum* | 1.00E−102 |
| 861 | G1062 | AT3G26744 | SGN-UNIGENE-SINGLET-106 | *Lycopersicon esculentum* | 5.00E−07 |
| 861 | G1062 | AT3G26744 | SGN-UNIGENE-SINGLET-107 | *Lycopersicon esculentum* | 2.00E−10 |
| 861 | G1062 | AT3G26744 | SGN-UNIGENE-SINGLET-395584 | *Lycopersicon esculentum* | 2.00E−60 |
| 861 | G1062 | AT3G26744 | SGN-UNIGENE-SINGLET-399204 | *Lycopersicon esculentum* | 1.00E−20 |
| 861 | G1062 | AT3G26744 | SGN-UNIGENE-SINGLET-459012 | *Lycopersicon esculentum* | 2.00E−07 |
| 861 | G1062 | AT3G26744 | Pta_S15739278 | *Pinus taeda* | 4.00E−18 |
| 861 | G1062 | AT3G26744 | Vvi_S15370409 | *Vitis vinifera* | 5.00E−47 |
| 239 | G1069 | AT4G14465 | SGN-UNIGENE-59076 | *Lycopersicon esculentum* | 6.00E−55 |
| 239 | G1069 | AT4G14465 | Mtr_S5308977 | *Medicago truncatula* | 2.00E−31 |
| 239 | G1069 | AT4G14465 | Vvi_S16805621 | *Vitis vinifera* | 1.00E−04 |
| 863 | G1129 | AT4G34530 | Vvi_S16532165 | *Vitis vinifera* | 4.00E−53 |
| 865 | G1137 | AT5G64340 | SGN-UNIGENE-48745 | *Lycopersicon esculentum* | 3.00E−11 |
| 865 | G1137 | AT5G64340 | SGN-UNIGENE-48746 | *Lycopersicon esculentum* | 6.00E−23 |
| 657 | G1412 | AT4G27410 | Gma_S5050636 | *Glycine max* | 5.00E−84 |
| 657 | G1412 | AT4G27410 | Les_S5295623 | *Lycopersicon esculentum* | 1.00E−105 |
| 657 | G1412 | AT4G27410 | SGN-UNIGENE-45948 | *Lycopersicon esculentum* | 1.00E−105 |
| 657 | G1412 | AT4G27410 | SGN-UNIGENE-48215 | *Lycopersicon esculentum* | 1.00E−105 |
| 657 | G1412 | AT4G27410 | Vvi_S15352716 | *Vitis vinifera* | 0.41 |
| 867 | G1425 | AT1G52880 | Les_S5247376 | *Lycopersicon esculentum* | 6.00E−83 |
| 867 | G1425 | AT1G52880 | SGN-UNIGENE-44943 | *Lycopersicon esculentum* | 1.00E−95 |
| 867 | G1425 | AT1G52880 | SGN-UNIGENE-46578 | *Lycopersicon esculentum* | 8.00E−93 |
| 867 | G1425 | AT1G52880 | Pta_S16844825 | *Pinus taeda* | 1.00E−56 |
| 867 | G1425 | AT1G52880 | Pta_S17050992 | *Pinus taeda* | 2.00E−54 |
| 871 | G1655 | AT1G09250 | Gma_S4865861 | *Glycine max* | 4.00E−17 |
| 871 | G1655 | AT1G09250 | SGN-UNIGENE-47983 | *Lycopersicon esculentum* | 1.00E−37 |
| 875 | G1789 | AT2G21650 | Gma_S4886781 | *Glycine max* | 7.00E−25 |
| 875 | G1789 | AT2G21650 | Les_S5295408 | *Lycopersicon esculentum* | 2.00E−28 |
| 875 | G1789 | AT2G21650 | Ta_S102809 | *Triticum aestivum* | 3.00E−22 |
| 875 | G1789 | AT2G21650 | Ta_S56880 | *Triticum aestivum* | 1.00E−18 |
| 875 | G1789 | AT2G21650 | Vvi_S15406920 | *Vitis vinifera* | 3.00E−13 |
| 875 | G1789 | AT2G21650 | Vvi_S15424752 | *Vitis vinifera* | 7.00E−26 |
| 875 | G1789 | AT2G21650 | Vvi_S16784697 | *Vitis vinifera* | 1.00E−27 |
| 875 | G1789 | AT2G21650 | Zm_S11328185 | *Zea mays* | 8.00E−14 |
| 875 | G1789 | AT2G21650 | Zm_S11474298 | *Zea mays* | 2.00E−16 |
| 877 | G1806 | AT1G68640 | Gma_S4902665 | *Glycine max* | 3.00E−19 |
| 877 | G1806 | AT1G68640 | Gma_S4911209 | *Glycine max* | 5.00E−65 |
| 877 | G1806 | AT1G68640 | Gma_S5146796 | *Glycine max* | 1.00E−139 |
| 877 | G1806 | AT1G68640 | Hv_S227616 | *Hordeum vulgare* | 2.00E−42 |
| 877 | G1806 | AT1G68640 | Hv_S27170 | *Hordeum vulgare* | 4.00E−52 |
| 877 | G1806 | AT1G68640 | Les_S5295407 | *Lycopersicon esculentum* | 1.00E−120 |
| 877 | G1806 | AT1G68640 | Les_S5295673 | *Lycopersicon esculentum* | 9.00E−99 |
| 877 | G1806 | AT1G68640 | SGN-UNIGENE-46372 | *Lycopersicon esculentum* | 3.00E−78 |

TABLE 8-continued

Orthologs of Representative *Arabidopsis* Transcription Factor Genes Identified Using BLAST

| Clade Identifier (SEQ ID NO:) | Clade Identifier (GID) | AGI Identifier for Clade Identifier | UniGene Identifier | Species | p-Value |
|---|---|---|---|---|---|
| 877 | G1806 | AT1G68640 | SGN-UNIGENE-46373 | *Lycopersicon esculentum* | 1.00E−134 |
| 877 | G1806 | AT1G68640 | SGN-UNIGENE-47327 | *Lycopersicon esculentum* | 1.00E−139 |
| 877 | G1806 | AT1G68640 | SGN-UNIGENE-49500 | *Lycopersicon esculentum* | 9.00E−51 |
| 877 | G1806 | AT1G68640 | SGN-UNIGENE-50258 | *Lycopersicon esculentum* | 4.00E−89 |
| 877 | G1806 | AT1G68640 | SGN-UNIGENE-57605 | *Lycopersicon esculentum* | 4.00E−06 |
| 877 | G1806 | AT1G68640 | SGN-UNIGENE-57705 | *Lycopersicon esculentum* | 3.00E−84 |
| 877 | G1806 | AT1G68640 | SGN-UNIGENE-58538 | *Lycopersicon esculentum* | 6.00E−97 |
| 877 | G1806 | AT1G68640 | SGN-UNIGENE-SINGLET-318510 | *Lycopersicon esculentum* | 6.00E−04 |
| 877 | G1806 | AT1G68640 | SGN-UNIGENE-SINGLET-340722 | *Lycopersicon esculentum* | 6.00E−26 |
| 877 | G1806 | AT1G68640 | SGN-UNIGENE-SINGLET-43282 | *Lycopersicon esculentum* | 8.00E−63 |
| 877 | G1806 | AT1G68640 | Mtr_S7091737 | *Medicago truncatula* | 8.00E−29 |
| 877 | G1806 | AT1G68640 | Os_S107700 | *Oryza sativa* | 4.00E−04 |
| 877 | G1806 | AT1G68640 | Os_S83289 | *Oryza sativa* | 1.00E−144 |
| 877 | G1806 | AT1G68640 | Os_S83290 | *Oryza sativa* | 1.00E−139 |
| 877 | G1806 | AT1G68640 | Os_S83291 | *Oryza sativa* | 1.00E−139 |
| 877 | G1806 | AT1G68640 | Os_S83292 | *Oryza sativa* | 1.00E−138 |
| 877 | G1806 | AT1G68640 | Pta_S17047774 | *Pinus taeda* | 1.00E−56 |
| 877 | G1806 | AT1G68640 | Pta_S17049082 | *Pinus taeda* | 5.00E−17 |
| 877 | G1806 | AT1G68640 | Ta_S115084 | *Triticum aestivum* | 1.00E−19 |
| 877 | G1806 | AT1G68640 | Ta_S141705 | *Triticum aestivum* | 5.00E−10 |
| 877 | G1806 | AT1G68640 | Ta_S142610 | *Triticum aestivum* | 2.00E−15 |
| 877 | G1806 | AT1G68640 | Ta_S66308 | *Triticum aestivum* | 1.00E−136 |
| 877 | G1806 | AT1G68640 | Ta_S66461 | *Triticum aestivum* | 1.00E−142 |
| 877 | G1806 | AT1G68640 | Vvi_S15429865 | *Vitis vinifera* | 2.00E−76 |
| 877 | G1806 | AT1G68640 | Vvi_S16526894 | *Vitis vinifera* | 1.00E−80 |
| 877 | G1806 | AT1G68640 | Zm_S11418176 | *Zea mays* | 1.00E−141 |
| 877 | G1806 | AT1G68640 | Zm_S11418177 | *Zea mays* | 1.00E−138 |
| 877 | G1806 | AT1G68640 | Zm_S11418513 | *Zea mays* | 1.00E−118 |
| 877 | G1806 | AT1G68640 | Zm_S11425511 | *Zea mays* | 6.00E−58 |
| 877 | G1806 | AT1G68640 | Zm_S11432162 | *Zea mays* | 4.00E−29 |
| 879 | G1911 | AT4G39250 | Gma_S4886781 | *Glycine max* | 7.00E−25 |
| 879 | G1911 | AT4G39250 | Les_S5295408 | *Lycopersicon esculentum* | 2.00E−28 |
| 879 | G1911 | AT4G39250 | Ta_S102809 | *Triticum aestivum* | 3.00E−22 |
| 879 | G1911 | AT4G39250 | Ta_S56880 | *Triticum aestivum* | 1.00E−18 |
| 879 | G1911 | AT4G39250 | Vvi_S15406920 | *Vitis vinifera* | 3.00E−13 |
| 879 | G1911 | AT4G39250 | Vvi_S15424752 | *Vitis vinifera* | 7.00E−26 |
| 879 | G1911 | AT4G39250 | Vvi_S16784697 | *Vitis vinifera* | 1.00E−27 |
| 879 | G1911 | AT4G39250 | Zm_S11328185 | *Zea mays* | 8.00E−14 |
| 879 | G1911 | AT4G39250 | Zm_S11474298 | *Zea mays* | 2.00E−16 |
| 813 | G1995 | AT3G58070 | SGN-UNIGENE-54039 | *Lycopersicon esculentum* | 1.00E−22 |
| 813 | G1995 | AT3G58070 | SGN-UNIGENE-54252 | *Lycopersicon esculentum* | 8.00E−32 |
| 813 | G1995 | AT3G58070 | SGN-UNIGENE-SINGLET-392715 | *Lycopersicon esculentum* | 7.00E−36 |
| 813 | G1995 | AT3G58070 | Pta_S15742384 | *Pinus taeda* | 1.00E−09 |
| 881 | G2011 | AT5G03720 | Les_S5182191 | *Lycopersicon esculentum* | 8.00E−29 |
| 881 | G2011 | AT5G03720 | SGN-UNIGENE-47254 | *Lycopersicon esculentum* | 1.00E−28 |
| 881 | G2011 | AT5G03720 | Os_S100853 | *Oryza sativa* | 1.00E−56 |
| 881 | G2011 | AT5G03720 | Ta_S147235 | *Triticum aestivum* | 4.00E−14 |
| 315 | G2155 | AT1G14490 | Gma_S5081748 | *Glycine max* | 2.00E−48 |
| 315 | G2155 | AT1G14490 | SGN-UNIGENE-48878 | *Lycopersicon esculentum* | 5.00E−81 |
| 315 | G2155 | AT1G14490 | SGN-UNIGENE-SINGLET-471786 | *Lycopersicon esculentum* | 8.00E−48 |
| 315 | G2155 | AT1G14490 | Pta_S16802278 | *Pinus taeda* | 2.00E−34 |
| 885 | G2452 | AT5G01200 | Zm_S11467963 | *Zea mays* | 4.00E−15 |
| 815 | G2467 | AT3G63350 | SGN-UNIGENE-45592 | *Lycopersicon esculentum* | 7.00E−57 |
| 889 | G2510 | AT1G01250 | Gma_S4877810 | *Glycine max* | 4.00E−41 |
| 889 | G2510 | AT1G01250 | Gma_S5065417 | *Glycine max* | 2.00E−15 |
| 889 | G2510 | AT1G01250 | Mtr_S5455425 | *Medicago truncatula* | 1.00E−49 |
| 889 | G2510 | AT1G01250 | Pta_S15772552 | *Pinus taeda* | 6.00E−29 |
| 889 | G2510 | AT1G01250 | Pta_S15778451 | *Pinus taeda* | 6.00E−21 |
| 889 | G2510 | AT1G01250 | Vvi_S15351722 | *Vitis vinifera* | 2.00E−27 |
| 819 | G2550 | AT1G75410 | Mtr_S7094331 | *Medicago truncatula* | 8.00E−41 |
| 819 | G2550 | AT1G75410 | Zm_S11465618 | *Zea mays* | 1.00E−47 |
| 893 | G2571 | AT1G64380 | SGN-UNIGENE-56732 | *Lycopersicon esculentum* | 0.25 |
| 821 | G2640 | AT3G51060 | SGN-UNIGENE-58699 | *Lycopersicon esculentum* | 8.00E−42 |
| 821 | G2640 | AT3G51060 | SGN-UNIGENE-SINGLET-461966 | *Lycopersicon esculentum* | 9.00E−36 |
| 895 | G2702 | AT3G08500 | Gma_S5127272 | *Glycine max* | 2.00E−05 |
| 895 | G2702 | AT3G08500 | Pta_S16807545 | *Pinus taeda* | 3.00E−56 |
| 897 | G2763 | AT3G17100 | Pta_S16793632 | *Pinus taeda* | 2.00E−10 |

TABLE 8-continued

Orthologs of Representative *Arabidopsis* Transcription Factor Genes Identified Using BLAST

| Clade Identifier (SEQ ID NO:) | Clade Identifier (GID) | AGI Identifier for Clade Identifier | UniGene Identifier | Species | p-Value |
|---|---|---|---|---|---|
| 897 | G2763 | AT3G17100 | Vvi__S16806536 | *Vitis vinifera* | 6.00E−26 |
| 899 | G2774 | AT4G05170 | Mtr__S5310210 | *Medicago truncatula* | 9.00E−13 |
| 247 | G2789 | AT3G60870 | Gma__S4935598 | *Glycine max* | 2.00E−67 |
| 247 | G2789 | AT3G60870 | Pta__S15799222 | *Pinus taeda* | 6.00E−43 |
| 247 | G2789 | AT3G60870 | Pta__S16786360 | *Pinus taeda* | 2.00E−70 |
| 247 | G2789 | AT3G60870 | Pta__S16788492 | *Pinus taeda* | 7.00E−63 |
| 247 | G2789 | AT3G60870 | Pta__S16802054 | *Pinus taeda* | 1.00E−57 |
| 901 | G2888 | AT1G25250 | SGN-UNIGENE-SINGLET-25079 | *Lycopersicon esculentum* | 3.00E−37 |
| 901 | G2888 | AT1G25250 | Os__S101092 | *Oryza sativa* | 4.00E−10 |
| 901 | G2888 | AT1G25250 | Zm__S11429840 | *Zea mays* | 2.00E−41 |

Table 9 lists the gene identification number (GID) and homologous relationships found using analyses according to the Examples for the sequences of the Sequence Listing. Those sequences listed as "reference sequences" were originally determined by experimentation to confer drought tolerance when their expression was altered. Generally, each reference sequence was used to identify the clade in which functionally related homologous sequences may be found.

TABLE 9

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| 1 | G47 | DNA | *Arabidopsis thaliana* | Reference sequence; predicted polypeptide sequence is paralogous to G2133 |
| 2 | G47 | PRT | *Arabidopsis thaliana* | Reference sequence; paralogous to G2133 |
| 3 | G922 | DNA | *Arabidopsis thaliana* | Reference sequence |
| 4 | G922 | PRT | *Arabidopsis thaliana* | Reference sequence |
| 5 | G1274 | DNA | *Arabidopsis thaliana* | Reference sequence |
| 6 | G1274 | PRT | *Arabidopsis thaliana* | Reference sequence |
| 7 | G1792 | DNA | *Arabidopsis thaliana* | Reference sequence |
| 8 | G1792 | PRT | *Arabidopsis thaliana* | Reference sequence |
| 9 | G2053 | DNA | *Arabidopsis thaliana* | Reference sequence |
| 10 | G2053 | PRT | *Arabidopsis thaliana* | Reference sequence |
| 11 | G2133 | DNA | *Arabidopsis thaliana* | Reference sequence; predicted polypeptide sequence is paralogous to G47 |
| 12 | G2133 | PRT | *Arabidopsis thaliana* | Reference sequence; paralogous to G47 |
| 13 | G2999 | DNA | *Arabidopsis thaliana* | Reference sequence |
| 14 | G2999 | PRT | *Arabidopsis thaliana* | Reference sequence |
| 15 | G3086 | DNA | *Arabidopsis thaliana* | Reference sequence |
| 16 | G3086 | PRT | *Arabidopsis thaliana* | Reference sequence |
| 17 | G30 | DNA | *Arabidopsis thaliana* | Predicted polypeptide sequence is paralogous to G1792 |
| 18 | G30 | PRT | *Arabidopsis thaliana* | Paralogous to G1792 |
| 19 | G515 | DNA | *Arabidopsis thaliana* | Predicted polypeptide sequence is paralogous to G2053 |
| 20 | G515 | PRT | *Arabidopsis thaliana* | Paralogous to G2053 |
| 21 | G516 | DNA | *Arabidopsis thaliana* | Predicted polypeptide sequence is paralogous to G2053 |
| 22 | G516 | PRT | *Arabidopsis thaliana* | Paralogous to G2053 |
| 23 | G517 | DNA | *Arabidopsis thaliana* | Predicted polypeptide sequence is paralogous to G2053 |
| 24 | G517 | PRT | *Arabidopsis thaliana* | Paralogous to G2053 |
| 25 | G592 | DNA | *Arabidopsis thaliana* | Predicted polypeptide sequence is paralogous to G3086 |
| 26 | G592 | PRT | *Arabidopsis thaliana* | Paralogous to G3086 |
| 27 | G1134 | DNA | *Arabidopsis thaliana* | Predicted polypeptide sequence is paralogous to G3086 |
| 28 | G1134 | PRT | *Arabidopsis thaliana* | Paralogous to G3086 |
| 29 | G1275 | DNA | *Arabidopsis thaliana* | Predicted polypeptide sequence is paralogous to G1274 |
| 30 | G1275 | PRT | *Arabidopsis thaliana* | Paralogous to G1274 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| 31 | G1758 | DNA | Arabidopsis thaliana | Predicted polypeptide sequence is paralogous to G1274 |
| 32 | G1758 | PRT | Arabidopsis thaliana | Paralogous to G1274 |
| 33 | G1791 | DNA | Arabidopsis thaliana | Predicted polypeptide sequence is paralogous to G1792 |
| 34 | G1791 | PRT | Arabidopsis thaliana | Paralogous to G1792 |
| 35 | G1795 | DNA | Arabidopsis thaliana | Predicted polypeptide sequence is paralogous to G1792 |
| 36 | G1795 | PRT | Arabidopsis thaliana | Paralogous to G1792 |
| 37 | G2149 | DNA | Arabidopsis thaliana | Predicted polypeptide sequence is paralogous to G3086 |
| 38 | G2149 | PRT | Arabidopsis thaliana | Paralogous to G3086 |
| 39 | G2555 | DNA | Arabidopsis thaliana | Predicted polypeptide sequence is paralogous to G3086 |
| 40 | G2555 | PRT | Arabidopsis thaliana | Paralogous to G3086 |
| 41 | G2766 | DNA | Arabidopsis thaliana | Predicted polypeptide sequence is paralogous to G3086 |
| 42 | G2766 | PRT | Arabidopsis thaliana | Paralogous to G3086 |
| 43 | G2989 | DNA | Arabidopsis thaliana | Predicted polypeptide sequence is paralogous to G2999 |
| 44 | G2989 | PRT | Arabidopsis thaliana | Paralogous to G2999 |
| 45 | G2990 | DNA | Arabidopsis thaliana | Predicted polypeptide sequence is paralogous to G2999 |
| 46 | G2990 | PRT | Arabidopsis thaliana | Paralogous to G2999 |
| 47 | G2991 | DNA | Arabidopsis thaliana | Predicted polypeptide sequence is paralogous to G2999 |
| 48 | G2991 | PRT | Arabidopsis thaliana | Paralogous to G2999 |
| 49 | G2992 | DNA | Arabidopsis thaliana | Reference sequence; predicted polypeptide sequence is paralogous to G2999 |
| 50 | G2992 | PRT | Arabidopsis thaliana | Reference sequence; paralogous to G2999 |
| 51 | G2993 | DNA | Arabidopsis thaliana | Predicted polypeptide sequence is paralogous to G2999 |
| 52 | G2993 | PRT | Arabidopsis thaliana | Paralogous to G2999 |
| 53 | G2994 | DNA | Arabidopsis thaliana | Predicted polypeptide sequence is paralogous to G2999 |
| 54 | G2994 | PRT | Arabidopsis thaliana | Paralogous to G2999 |
| 55 | G2995 | DNA | Arabidopsis thaliana | Predicted polypeptide sequence is paralogous to G2999 |
| 56 | G2995 | PRT | Arabidopsis thaliana | Paralogous to G2999 |
| 57 | G2996 | DNA | Arabidopsis thaliana | Predicted polypeptide sequence is paralogous to G2999 |
| 58 | G2996 | PRT | Arabidopsis thaliana | Paralogous to G2999 |
| 59 | G2997 | DNA | Arabidopsis thaliana | Predicted polypeptide sequence is paralogous to G2999 |
| 60 | G2997 | PRT | Arabidopsis thaliana | Paralogous to G2999 |
| 61 | G2998 | DNA | Arabidopsis thaliana | Predicted polypeptide sequence is paralogous to G2999 |
| 62 | G2998 | PRT | Arabidopsis thaliana | Paralogous to G2999 |
| 63 | G3000 | DNA | Arabidopsis thaliana | Predicted polypeptide sequence is paralogous to G2999 |
| 64 | G3000 | PRT | Arabidopsis thaliana | Paralogous to G2999 |
| 65 | G3001 | DNA | Arabidopsis thaliana | Predicted polypeptide sequence is paralogous to G2999 |
| 66 | G3001 | PRT | Arabidopsis thaliana | Paralogous to G2999 |
| 67 | G3002 | DNA | Arabidopsis thaliana | Predicted polypeptide sequence is paralogous to G2999 |
| 68 | G3002 | PRT | Arabidopsis thaliana | Paralogous to G2999 |
| 69 | G3380 | DNA | Oryza sativa | Predicted polypeptide sequence is orthologous to G1792 |
| 70 | G3380 | PRT | Oryza sativa | Orthologous to G1792 |
| 71 | G3381 | DNA | Oryza sativa | Predicted polypeptide sequence is orthologous to G1792 |
| 72 | G3381 | PRT | Oryza sativa | Orthologous to G1792 |
| 73 | G3383 | DNA | Oryza sativa | Predicted polypeptide sequence is orthologous to G1792 |
| 74 | G3383 | PRT | Oryza sativa | Orthologous to G1792 |
| 75 | G3515 | DNA | Oryza sativa | Predicted polypeptide sequence is orthologous to G1792 |
| 76 | G3515 | PRT | Oryza sativa | Orthologous to G1792 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| 77 | G3516 | DNA | *Zea mays* | Predicted polypeptide sequence is orthologous to G1792 |
| 78 | G3516 | PRT | *Zea mays* | Orthologous to G1792 |
| 79 | G3517 | DNA | *Zea mays* | Predicted polypeptide sequence is orthologous to G1792 |
| 80 | G3517 | PRT | *Zea mays* | Orthologous to G1792 |
| 81 | G3518 | DNA | *Glycine max* | Predicted polypeptide sequence is orthologous to G1792 |
| 82 | G3518 | PRT | *Glycine max* | Orthologous to G1792 |
| 83 | G3519 | DNA | *Glycine max* | Predicted polypeptide sequence is orthologous to G1792 |
| 84 | G3519 | PRT | *Glycine max* | Orthologous to G1792 |
| 85 | G3520 | DNA | *Glycine max* | Predicted polypeptide sequence is orthologous to G1792 |
| 86 | G3520 | PRT | *Glycine max* | Orthologous to G1792 |
| 87 | G3643 | DNA | *Glycine max* | Predicted polypeptide sequence is orthologous to G47 |
| 88 | G3643 | PRT | *Glycine max* | Orthologous to G47 |
| 89 | G3644 | DNA | *Oryza sativa* | Predicted polypeptide sequence is orthologous to G47 |
| 90 | G3644 | PRT | *Oryza sativa* | Orthologous to G47 |
| 91 | G3645 | DNA | *Brassica rapa* subsp. *Pekinensis* | Predicted polypeptide sequence is orthologous to G47 |
| 92 | G3645 | PRT | *Brassica rapa* subsp. *Pekinensis* | Orthologous to G47 |
| 93 | G3646 | DNA | *Brassica oleracea* | Predicted polypeptide sequence is orthologous to G47 |
| 94 | G3646 | PRT | *Brassica oleracea* | Orthologous to G47 |
| 95 | G3647 | DNA | *Zinnia elegans* | Predicted polypeptide sequence is orthologous to G47 |
| 96 | G3647 | PRT | *Zinnia elegans* | Orthologous to G47 |
| 97 | G3649 | DNA | *Oryza sativa* | Predicted polypeptide sequence is orthologous to G47 |
| 98 | G3649 | PRT | *Oryza sativa* | Orthologous to G47 |
| 99 | G3651 | DNA | *Oryza sativa* | Predicted polypeptide sequence is orthologous to G47 |
| 100 | G3651 | PRT | *Oryza sativa* | Orthologous to G47 |
| 101 | G3663 | DNA | *Lotus corniculatus* var. *japonicus* | Predicted polypeptide sequence is orthologous to G2999 |
| 102 | G3663 | PRT | *Lotus corniculatus* var. *japonicus* | Orthologous to G2999 |
| 103 | G3668 | DNA | *Flaveria bidentis* | Predicted polypeptide sequence is orthologous to G2999 |
| 104 | G3668 | PRT | *Flaveria bidentis* | Orthologous to G2999 |
| 105 | G3670 | DNA | *Lotus corniculatus* var. *japonicus* | Predicted polypeptide sequence is orthologous to G2999 |
| 106 | G3670 | PRT | *Lotus corniculatus* var. *japonicus* | Orthologous to G2999 |
| 107 | G3671 | DNA | *Oryza sativa* | Predicted polypeptide sequence is orthologous to G2999 |
| 108 | G3671 | PRT | *Oryza sativa* | Orthologous to G2999 |
| 109 | G3674 | DNA | *Oryza sativa* | Predicted polypeptide sequence is orthologous to G2999 |
| 110 | G3674 | PRT | *Oryza sativa* | Orthologous to G2999 |
| 111 | G3675 | DNA | *Brassica napus* | Predicted polypeptide sequence is orthologous to G2999 |
| 112 | G3675 | PRT | *Brassica napus* | Orthologous to G2999 |
| 113 | G3680 | DNA | *Zea mays* | Predicted polypeptide sequence is orthologous to G2999 |
| 114 | G3680 | PRT | *Zea mays* | Orthologous to G2999 |
| 115 | G3683 | DNA | *Oryza sativa* | Predicted polypeptide sequence is orthologous to G2999 |
| 116 | G3683 | PRT | *Oryza sativa* | Orthologous to G2999 |
| 117 | G3685 | DNA | *Oryza sativa* | Predicted polypeptide sequence is orthologous to G2999 |
| 118 | G3685 | PRT | *Oryza sativa* | Orthologous to G2999 |
| 119 | G3686 | DNA | *Oryza sativa* | Predicted polypeptide sequence is orthologous to G2999 |
| 120 | G3686 | PRT | *Oryza sativa* | Orthologous to G2999 |
| 121 | G3690 | DNA | *Oryza sativa* | Predicted polypeptide sequence is orthologous to G2999 |
| 122 | G3690 | PRT | *Oryza sativa* | Orthologous to G2999 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| 123 | G3692 | DNA | *Oryza sativa* | Predicted polypeptide sequence is orthologous to G2999 |
| 124 | G3692 | PRT | *Oryza sativa* | Orthologous to G2999 |
| 125 | G3694 | DNA | *Oryza sativa* | Predicted polypeptide sequence is orthologous to G2999 |
| 126 | G3694 | PRT | *Oryza sativa* | Orthologous to G2999 |
| 127 | G3695 | DNA | *Oryza sativa* | Predicted polypeptide sequence is orthologous to G2999 |
| 128 | G3695 | PRT | *Oryza sativa* | Orthologous to G2999 |
| 129 | G3719 | DNA | *Zea mays* | Predicted polypeptide sequence is orthologous to G1274 |
| 130 | G3719 | PRT | *Zea mays* | Orthologous to G1274 |
| 131 | G3720 | DNA | *Zea mays* | Predicted polypeptide sequence is orthologous to G1274 |
| 132 | G3720 | PRT | *Zea mays* | Orthologous to G1274 |
| 133 | G3721 | DNA | *Oryza sativa* | Predicted polypeptide sequence is orthologous to G1274 |
| 134 | G3721 | PRT | *Oryza sativa* | Orthologous to G1274 |
| 135 | G3722 | DNA | *Zea mays* | Predicted polypeptide sequence is orthologous to G1274 |
| 136 | G3722 | PRT | *Zea mays* | Orthologous to G1274 |
| 137 | G3723 | DNA | *Glycine max* | Predicted polypeptide sequence is orthologous to G1274 |
| 138 | G3723 | PRT | *Glycine max* | Orthologous to G1274 |
| 139 | G3724 | DNA | *Glycine max* | Predicted polypeptide sequence is orthologous to G1274 |
| 140 | G3724 | PRT | *Glycine max* | Orthologous to G1274 |
| 141 | G3725 | DNA | *Oryza sativa* | Predicted polypeptide sequence is orthologous to G1274 |
| 142 | G3725 | PRT | *Oryza sativa* | Orthologous to G1274 |
| 143 | G3726 | DNA | *Oryza sativa* | Predicted polypeptide sequence is orthologous to G1274 |
| 144 | G3726 | PRT | *Oryza sativa* | Orthologous to G1274 |
| 145 | G3727 | DNA | *Zea mays* | Predicted polypeptide sequence is orthologous to G1274 |
| 146 | G3727 | PRT | *Zea mays* | Orthologous to G1274 |
| 147 | G3728 | DNA | *Zea mays* | Predicted polypeptide sequence is orthologous to G1274 |
| 148 | G3728 | PRT | *Zea mays* | Orthologous to G1274 |
| 149 | G3729 | DNA | *Oryza sativa* | Predicted polypeptide sequence is orthologous to G1274 |
| 150 | G3729 | PRT | *Oryza sativa* | Orthologous to G1274 |
| 151 | G3730 | DNA | *Oryza sativa* | Predicted polypeptide sequence is orthologous to G1274 |
| 152 | G3730 | PRT | *Oryza sativa* | Orthologous to G1274 |
| 153 | G3731 | DNA | *Lycopersicon esculentum* | Predicted polypeptide sequence is orthologous to G1274 |
| 154 | G3731 | PRT | *Lycopersicon esculentum* | Orthologous to G1274 |
| 155 | G3732 | DNA | *Solanum tuberosum* | Predicted polypeptide sequence is orthologous to G1274 |
| 156 | G3732 | PRT | *Solanum tuberosum* | Orthologous to G1274 |
| 157 | G3733 | DNA | *Hordeum vulgare* | Predicted polypeptide sequence is orthologous to G1274 |
| 158 | G3733 | PRT | *Hordeum vulgare* | Orthologous to G1274 |
| 159 | G3735 | DNA | *Medicago truncatula* | Predicted polypeptide sequence is orthologous to G1792 |
| 160 | G3735 | PRT | *Medicago truncatula* | Orthologous to G1792 |
| 161 | G3736 | DNA | *Triticum aestivum* | Predicted polypeptide sequence is orthologous to G1792 |
| 162 | G3736 | PRT | *Triticum aestivum* | Orthologous to G1792 |
| 163 | G3737 | DNA | *Oryza sativa* | Predicted polypeptide sequence is orthologous to G1792 |
| 164 | G3737 | PRT | *Oryza sativa* | Orthologous to G1792 |
| 165 | G3739 | DNA | *Zea mays* | Predicted polypeptide sequence is orthologous to G1792 |
| 166 | G3739 | PRT | *Zea mays* | Orthologous to G1792 |
| 167 | G3740 | DNA | *Oryza sativa* | Predicted polypeptide sequence is orthologous to G3086 |
| 168 | G3740 | PRT | *Oryza sativa* | Orthologous to G3086 |
| 169 | G3741 | DNA | *Oryza sativa* | Predicted polypeptide sequence is orthologous to G3086 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| 170 | G3741 | PRT | *Oryza sativa* | Orthologous to G3086 |
| 171 | G3742 | DNA | *Oryza sativa* | Predicted polypeptide sequence is orthologous to G3086 |
| 172 | G3742 | PRT | *Oryza sativa* | Orthologous to G3086 |
| 173 | G3744 | DNA | *Oryza sativa* | Predicted polypeptide sequence is orthologous to G3086 |
| 174 | G3744 | PRT | *Oryza sativa* | Orthologous to G3086 |
| 175 | G3746 | DNA | *Oryza sativa* | Predicted polypeptide sequence is orthologous to G3086 |
| 176 | G3746 | PRT | *Oryza sativa* | Orthologous to G3086 |
| 177 | G3755 | DNA | *Zea mays* | Predicted polypeptide sequence is orthologous to G3086 |
| 178 | G3755 | PRT | *Zea mays* | Orthologous to G3086 |
| 179 | G3763 | DNA | *Glycine max* | Predicted polypeptide sequence is orthologous to G3086 |
| 180 | G3763 | PRT | *Glycine max* | Orthologous to G3086 |
| 181 | G3764 | DNA | *Glycine max* | Predicted polypeptide sequence is orthologous to G3086 |
| 182 | G3764 | PRT | *Glycine max* | Orthologous to G3086 |
| 183 | G3765 | DNA | *Glycine max* | Predicted polypeptide sequence is orthologous to G3086 |
| 184 | G3765 | PRT | *Glycine max* | Orthologous to G3086 |
| 185 | G3766 | DNA | *Glycine max* | Predicted polypeptide sequence is orthologous to G3086 |
| 186 | G3766 | PRT | *Glycine max* | Orthologous to G3086 |
| 187 | G3767 | DNA | *Glycine max* | Predicted polypeptide sequence is orthologous to G3086 |
| 188 | G3767 | PRT | *Glycine max* | Orthologous to G3086 |
| 189 | G3768 | DNA | *Glycine max* | Predicted polypeptide sequence is orthologous to G3086 |
| 190 | G3768 | PRT | *Glycine max* | Orthologous to G3086 |
| 191 | G3769 | DNA | *Glycine max* | Predicted polypeptide sequence is orthologous to G3086 |
| 192 | G3769 | PRT | *Glycine max* | Orthologous to G3086 |
| 193 | G3771 | DNA | *Glycine max* | Predicted polypeptide sequence is orthologous to G3086 |
| 194 | G3771 | PRT | *Glycine max* | Orthologous to G3086 |
| 195 | G3772 | DNA | *Glycine max* | Predicted polypeptide sequence is orthologous to G3086 |
| 196 | G3772 | PRT | *Glycine max* | Orthologous to G3086 |
| 197 | G3782 | DNA | *Pinus taeda* | Predicted polypeptide sequence is orthologous to G3086 |
| 198 | G3782 | PRT | *Pinus taeda* | Orthologous to G3086 |
| 199 | G3794 | DNA | *Zea mays* | Predicted polypeptide sequence is orthologous to G1792 |
| 200 | G3794 | PRT | *Zea mays* | Orthologous to G1792 |
| 201 | G3795 | DNA | *Capsicum annuum* | Predicted polypeptide sequence is orthologous to G1274 |
| 202 | G3795 | PRT | *Capsicum annuum* | Orthologous to G1274 |
| 203 | G3797 | DNA | *Lactuca sativa* | Predicted polypeptide sequence is orthologous to G1274 |
| 204 | G3797 | PRT | *Lactuca sativa* | Orthologous to G1274 |
| 205 | G3802 | DNA | *Sorghum bicolor* | Predicted polypeptide sequence is orthologous to G1274 |
| 206 | G3802 | PRT | *Sorghum bicolor* | Orthologous to G1274 |
| 207 | G3803 | DNA | *Glycine max* | Predicted polypeptide sequence is orthologous to G1274 |
| 208 | G3803 | PRT | *Glycine max* | Orthologous to G1274 |
| 209 | G3804 | DNA | *Zea mays* | Predicted polypeptide sequence is orthologous to G1274 |
| 210 | G3804 | PRT | *Zea mays* | Orthologous to G1274 |
| 211 | G3810 | DNA | *Glycine max* | Predicted polypeptide sequence is orthologous to G922 |
| 212 | G3810 | PRT | *Glycine max* | Orthologous to G922 |
| 213 | G3811 | DNA | *Glycine max* | Predicted polypeptide sequence is orthologous to G922 |
| 214 | G3811 | PRT | *Glycine max* | Orthologous to G922 |
| 215 | G3813 | DNA | *Oryza sativa* | Predicted polypeptide sequence is orthologous to G922 |
| 216 | G3813 | PRT | *Oryza sativa* | Orthologous to G922 |
| 217 | G3814 | DNA | *Oryza sativa* | Predicted polypeptide sequence is orthologous to G922 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| 218 | G3814 | PRT | *Oryza sativa* | Orthologous to G922 |
| 219 | G3824 | DNA | *Lycopersicon esculentum* | Predicted polypeptide sequence is orthologous to G922 |
| 220 | G3824 | PRT | *Lycopersicon esculentum* | Orthologous to G922 |
| 221 | G3827 | DNA | *Oryza sativa* | Predicted polypeptide sequence is orthologous to G922 |
| 222 | G3827 | PRT | *Oryza sativa* | Orthologous to G922 |
| 223 | G175 | DNA | *Arabidopsis thaliana* | Reference sequence |
| 224 | G175 | PRT | *Arabidopsis thaliana* | Reference sequence |
| 225 | G303 | DNA | *Arabidopsis thaliana* | Reference sequence |
| 226 | G303 | PRT | *Arabidopsis thaliana* | Reference sequence |
| 227 | G354 | DNA | *Arabidopsis thaliana* | Reference sequence |
| 228 | G354 | PRT | *Arabidopsis thaliana* | Reference sequence |
| 229 | G489 | DNA | *Arabidopsis thaliana* | Reference sequence |
| 230 | G489 | PRT | *Arabidopsis thaliana* | Reference sequence |
| 231 | G634 | DNA | *Arabidopsis thaliana* | Reference sequence |
| 232 | G634 | PRT | *Arabidopsis thaliana* | Reference sequence |
| 233 | G682 | DNA | *Arabidopsis thaliana* | Reference sequence |
| 234 | G682 | PRT | *Arabidopsis thaliana* | Reference sequence |
| 235 | G916 | DNA | *Arabidopsis thaliana* | Reference sequence |
| 236 | G916 | PRT | *Arabidopsis thaliana* | Reference sequence |
| 237 | G975 | DNA | *Arabidopsis thaliana* | Reference sequence; predicted polypeptide sequence is paralogous to G2583 |
| 238 | G975 | PRT | *Arabidopsis thaliana* | Reference sequence; paralogous to G2583 |
| 239 | G1069 | DNA | *Arabidopsis thaliana* | Reference sequence; functionally related, homologous to G1073 |
| 240 | G1069 | PRT | *Arabidopsis thaliana* | Reference sequence; functionally related, homologous to G1073 |
| 241 | G1452 | DNA | *Arabidopsis thaliana* | Reference sequence; functionally related, homologous to G512 |
| 242 | G1452 | PRT | *Arabidopsis thaliana* | Reference sequence; functionally related, homologous to G512 |
| 243 | G1820 | DNA | *Arabidopsis thaliana* | Reference sequence |
| 244 | G1820 | PRT | *Arabidopsis thaliana* | Reference sequence |
| 245 | G2701 | DNA | *Arabidopsis thaliana* | Reference sequence; predicted polypeptide sequence is paralogous to G1634 |
| 246 | G2701 | PRT | *Arabidopsis thaliana* | Reference sequence; paralogous to G1634 |
| 247 | G2789 | DNA | *Arabidopsis thaliana* | Reference sequence; predicted polypeptide sequence is paralogous to G596 |
| 248 | G2789 | PRT | *Arabidopsis thaliana* | Reference sequence; paralogous to G596 |
| 249 | G2839 | DNA | *Arabidopsis thaliana* | Reference sequence; predicted polypeptide sequence is paralogous to G354 |
| 250 | G2839 | PRT | *Arabidopsis thaliana* | Reference sequence; paralogous to G354 |
| 251 | G2854 | DNA | *Arabidopsis thaliana* | Reference sequence; predicted polypeptide sequence is paralogous to G1940 |
| 252 | G2854 | PRT | *Arabidopsis thaliana* | Reference sequence; paralogous to G1940 |
| 253 | G3083 | DNA | *Arabidopsis thaliana* | Reference sequence |
| 254 | G3083 | PRT | *Arabidopsis thaliana* | Reference sequence |
| 255 | G184 | DNA | *Arabidopsis thaliana* | Predicted polypeptide sequence is paralogous to G916 |
| 256 | G184 | PRT | *Arabidopsis thaliana* | Paralogous to G916 |
| 257 | G186 | DNA | *Arabidopsis thaliana* | Predicted polypeptide sequence is paralogous to G916 |
| 258 | G186 | PRT | *Arabidopsis thaliana* | Paralogous to G916 |
| 259 | G353 | DNA | *Arabidopsis thaliana* | Predicted polypeptide sequence is paralogous to G354 |
| 260 | G353 | PRT | *Arabidopsis thaliana* | Paralogous to G354 |
| 261 | G512 | DNA | *Arabidopsis thaliana* | Predicted polypeptide sequence is paralogous to G1452 |
| 262 | G512 | PRT | *Arabidopsis thaliana* | Paralogous to G1452 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| 263 | G596 | DNA | *Arabidopsis thaliana* | Predicted polypeptide sequence is paralogous to G2789 |
| 264 | G596 | PRT | *Arabidopsis thaliana* | Paralogous to G2789 |
| 265 | G714 | DNA | *Arabidopsis thaliana* | Predicted polypeptide sequence is paralogous to G489 |
| 266 | G714 | PRT | *Arabidopsis thaliana* | Paralogous to G489 |
| 267 | G877 | DNA | *Arabidopsis thaliana* | Predicted polypeptide sequence is paralogous to G175 |
| 268 | G877 | PRT | *Arabidopsis thaliana* | Paralogous to G175 |
| 269 | G1357 | DNA | *Arabidopsis thaliana* | Predicted polypeptide sequence is paralogous to G1452 |
| 270 | G1357 | PRT | *Arabidopsis thaliana* | Paralogous to G1452 |
| 271 | G1387 | DNA | *Arabidopsis thaliana* | Predicted polypeptide sequence is paralogous to G975 |
| 272 | G1387 | PRT | *Arabidopsis thaliana* | Paralogous to G975 |
| 273 | G1634 | DNA | *Arabidopsis thaliana* | Predicted polypeptide sequence is paralogous to G2701 |
| 274 | G1634 | PRT | *Arabidopsis thaliana* | Paralogous to G2701 |
| 275 | G1889 | DNA | *Arabidopsis thaliana* | Predicted polypeptide sequence is paralogous to G354 |
| 276 | G1889 | PRT | *Arabidopsis thaliana* | Paralogous to G354 |
| 277 | G1940 | DNA | *Arabidopsis thaliana* | Predicted polypeptide sequence is paralogous to G2854 |
| 278 | G1940 | PRT | *Arabidopsis thaliana* | Paralogous to G2854 |
| 279 | G1974 | DNA | *Arabidopsis thaliana* | Predicted polypeptide sequence is paralogous to G354 |
| 280 | G1974 | PRT | *Arabidopsis thaliana* | Paralogous to G354 |
| 281 | G2153 | DNA | *Arabidopsis thaliana* | Predicted polypeptide sequence is paralogous to G1073 |
| 282 | G2153 | PRT | *Arabidopsis thaliana* | Paralogous to G1073 |
| 283 | G2583 | DNA | *Arabidopsis thaliana* | Predicted polypeptide sequence is paralogous to G975 |
| 284 | G2583 | PRT | *Arabidopsis thaliana* | Paralogous to G975 |
| 285 | G226 | DNA | *Arabidopsis thaliana* | Reference sequence; predicted polypeptide sequence is paralogous to G682 |
| 286 | G226 | PRT | *Arabidopsis thaliana* | Reference sequence; paralogous to G682 |
| 287 | G481 | DNA | *Arabidopsis thaliana* | Reference sequence; predicted polypeptide sequence is paralogous to G482 |
| 288 | G481 | PRT | *Arabidopsis thaliana* | Reference sequence; paralogous to G482 |
| 289 | G482 | DNA | *Arabidopsis thaliana* | Reference sequence; predicted polypeptide sequence is paralogous to G481 |
| 290 | G482 | PRT | *Arabidopsis thaliana* | Reference sequence; paralogous to G481 |
| 291 | G485 | DNA | *Arabidopsis thaliana* | Predicted polypeptide sequence is paralogous to G481 and G482 |
| 292 | G485 | PRT | *Arabidopsis thaliana* | Paralogous to G481 and G482 |
| 293 | G486 | DNA | *Arabidopsis thaliana* | Functionally related and homologous to G481 and G482 |
| 294 | G486 | PRT | *Arabidopsis thaliana* | Functionally related and homologous to G481 and G482 |
| 295 | G1067 | DNA | *Arabidopsis thaliana* | Predicted polypeptide sequence is paralogous to G1073 |
| 296 | G1067 | PRT | *Arabidopsis thaliana* | Paralogous to G1073 |
| 297 | G1070 | DNA | *Arabidopsis thaliana* | Functionally related and homologous to G1073 |
| 298 | G1070 | PRT | *Arabidopsis thaliana* | Functionally related and homologous to G1073 |
| 299 | G1073 | DNA | *Arabidopsis thaliana* | Reference sequence |
| 300 | G1073 | PRT | *Arabidopsis thaliana* | Reference sequence |
| 301 | G1075 | DNA | *Arabidopsis thaliana* | Functionally related and homologous to G1073 |
| 302 | G1075 | PRT | *Arabidopsis thaliana* | Functionally related and homologous to G1073 |
| 303 | G1076 | DNA | *Arabidopsis thaliana* | Functionally related and homologous to G1073 |
| 304 | G1076 | PRT | *Arabidopsis thaliana* | Functionally related and homologous to G1073 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| 305 | G1248 | DNA | *Arabidopsis thaliana* | Functionally related and homologous to G481 and G482 |
| 306 | G1248 | PRT | *Arabidopsis thaliana* | Functionally related and homologous to G481 and G482 |
| 307 | G1364 | DNA | *Arabidopsis thaliana* | Predicted polypeptide sequence is paralogous to G481 and G482 |
| 308 | G1364 | PRT | *Arabidopsis thaliana* | Paralogous to G481 and G482 |
| 309 | G1781 | DNA | *Arabidopsis thaliana* | Functionally related and homologous to G481 and G482 |
| 310 | G1781 | PRT | *Arabidopsis thaliana* | Functionally related and homologous to G481 and G482 |
| 311 | G1816 | DNA | *Arabidopsis thaliana* | Predicted polypeptide sequence is paralogous to G226 and G682 |
| 312 | G1816 | PRT | *Arabidopsis thaliana* | Paralogous to G226 and G682 |
| 313 | G1945 | DNA | *Arabidopsis thaliana* | Functionally related and homologous to G1073 |
| 314 | G1945 | PRT | *Arabidopsis thaliana* | Functionally related and homologous to G1073 |
| 315 | G2155 | DNA | *Arabidopsis thaliana* | Functionally related and homologous to G1073 |
| 316 | G2155 | PRT | *Arabidopsis thaliana* | Functionally related and homologous to G1073 |
| 317 | G2156 | DNA | *Arabidopsis thaliana* | Predicted polypeptide sequence is paralogous to G1073 |
| 318 | G2156 | PRT | *Arabidopsis thaliana* | Paralogous to G1073 |
| 319 | G2345 | DNA | *Arabidopsis thaliana* | Predicted polypeptide sequence is paralogous to G481 and G482 |
| 320 | G2345 | PRT | *Arabidopsis thaliana* | Paralogous to G481 and G482 |
| 321 | G2657 | DNA | *Arabidopsis thaliana* | Functionally related and homologous to G1073 |
| 322 | G2657 | PRT | *Arabidopsis thaliana* | Functionally related and homologous to G1073 |
| 323 | G2718 | DNA | *Arabidopsis thaliana* | Predicted polypeptide sequence is paralogous to G481 and G482 |
| 324 | G2718 | PRT | *Arabidopsis thaliana* | Paralogous to G481 and G482 |
| 325 | G3392 | DNA | *Oryza sativa* | Predicted polypeptide sequence is orthologous to G682 |
| 326 | G3392 | PRT | *Oryza sativa* | Orthologous to G682 |
| 327 | G3393 | DNA | *Oryza sativa* | Predicted polypeptide sequence is orthologous to G682 |
| 328 | G3393 | PRT | *Oryza sativa* | Orthologous to G682 |
| 329 | G3394 | DNA | *Oryza sativa* | Predicted polypeptide sequence is orthologous to G481 and G482 |
| 330 | G3394 | PRT | *Oryza sativa* | Orthologous to G481 and G482 |
| 331 | G3395 | DNA | *Oryza sativa* | Predicted polypeptide sequence is orthologous to G481 and G482 |
| 332 | G3395 | PRT | *Oryza sativa* | Orthologous to G481 and G482 |
| 333 | G3396 | DNA | *Oryza sativa* | Predicted polypeptide sequence is orthologous to G481 and G482 |
| 334 | G3396 | PRT | *Oryza sativa* | Orthologous to G481 and G482 |
| 335 | G3397 | DNA | *Oryza sativa* | Predicted polypeptide sequence is orthologous to G481 and G482 |
| 336 | G3397 | PRT | *Oryza sativa* | Orthologous to G481 and G482 |
| 337 | G3398 | DNA | *Oryza sativa* | Predicted polypeptide sequence is orthologous to G481 and G482 |
| 338 | G3398 | PRT | *Oryza sativa* | Orthologous to G481 and G482 |
| 339 | G3399 | DNA | *Oryza sativa* | Predicted polypeptide sequence is orthologous to G1073 |
| 340 | G3399 | PRT | *Oryza sativa* | Orthologous to G1073 |
| 341 | G3400 | DNA | *Oryza sativa* | Predicted polypeptide sequence is orthologous to G1073 |
| 342 | G3400 | PRT | *Oryza sativa* | Orthologous to G1073 |
| 343 | G3401 | DNA | *Oryza sativa* | Predicted polypeptide sequence is orthologous to G1073 |
| 344 | G3401 | PRT | *Oryza sativa* | Orthologous to G1073 |
| 345 | G3403 | DNA | *Oryza sativa* | Predicted polypeptide sequence is orthologous to G1073 |
| 346 | G3403 | PRT | *Oryza sativa* | Orthologous to G1073 |
| 347 | G3404 | DNA | *Oryza sativa* | Functionally related and homologous to G1073 |
| 348 | G3404 | PRT | *Oryza sativa* | Functionally related and homologous to G1073 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| 349 | G3405 | DNA | *Oryza sativa* | Functionally related and homologous to G1073 |
| 350 | G3405 | PRT | *Oryza sativa* | Functionally related and homologous to G1073 |
| 351 | G3406 | DNA | *Oryza sativa* | Functionally related and homologous to G1073 |
| 352 | G3406 | PRT | *Oryza sativa* | Functionally related and homologous to G1073 |
| 353 | G3407 | DNA | *Oryza sativa* | Functionally related and homologous to G1073 |
| 354 | G3407 | PRT | *Oryza sativa* | Functionally related and homologous to G1073 |
| 355 | G3408 | DNA | *Oryza sativa* | Functionally related and homologous to G1073 |
| 356 | G3408 | PRT | *Oryza sativa* | Functionally related and homologous to G1073 |
| 357 | G3429 | DNA | *Oryza sativa* | Predicted polypeptide sequence is orthologous to G481 and G482 |
| 358 | G3429 | PRT | *Oryza sativa* | Orthologous to G481 and G482 |
| 359 | G3431 | DNA | *Zea mays* | Predicted polypeptide sequence is orthologous to G682 |
| 360 | G3431 | PRT | *Zea mays* | Orthologous to G682 |
| 361 | G3434 | DNA | *Zea mays* | Predicted polypeptide sequence is orthologous to G481 and G482 |
| 362 | G3434 | PRT | *Zea mays* | Orthologous to G481 and G482 |
| 363 | G3435 | DNA | *Zea mays* | Predicted polypeptide sequence is orthologous to G481 and G482 |
| 364 | G3435 | PRT | *Zea mays* | Orthologous to G481 and G482 |
| 365 | G3436 | DNA | *Zea mays* | Predicted polypeptide sequence is orthologous to G481 and G482 |
| 366 | G3436 | PRT | *Zea mays* | Orthologous to G481 and G482 |
| 367 | G3437 | DNA | *Zea mays* | Predicted polypeptide sequence is orthologous to G481 and G482 |
| 368 | G3437 | PRT | *Zea mays* | Orthologous to G481 and G482 |
| 369 | G3444 | DNA | *Zea mays* | Predicted polypeptide sequence is orthologous to G682 |
| 370 | G3444 | PRT | *Zea mays* | Orthologous to G682 |
| 371 | G3445 | DNA | *Glycine max* | Predicted polypeptide sequence is orthologous to G682 |
| 372 | G3445 | PRT | *Glycine max* | Orthologous to G682 |
| 373 | G3446 | DNA | *Glycine max* | Predicted polypeptide sequence is orthologous to G682 |
| 374 | G3446 | PRT | *Glycine max* | Orthologous to G682 |
| 375 | G3447 | DNA | *Glycine max* | Predicted polypeptide sequence is orthologous to G682 |
| 376 | G3447 | PRT | *Glycine max* | Orthologous to G682 |
| 377 | G3448 | DNA | *Glycine max* | Predicted polypeptide sequence is orthologous to G682 |
| 378 | G3448 | PRT | *Glycine max* | Orthologous to G682 |
| 379 | G3449 | DNA | *Glycine max* | Predicted polypeptide sequence is orthologous to G682 |
| 380 | G3449 | PRT | *Glycine max* | Orthologous to G682 |
| 381 | G3450 | DNA | *Glycine max* | Predicted polypeptide sequence is orthologous to G682 |
| 382 | G3450 | PRT | *Glycine max* | Orthologous to G682 |
| 383 | G3456 | DNA | *Glycine max* | Predicted polypeptide sequence is orthologous to G1073 |
| 384 | G3456 | PRT | *Glycine max* | Orthologous to G1073 |
| 385 | G3458 | DNA | *Glycine max* | Functionally related and homologous to G1073 |
| 386 | G3458 | PRT | *Glycine max* | Functionally related and homologous to G1073 |
| 387 | G3459 | DNA | *Glycine max* | Predicted polypeptide sequence is functionally related and homologous to G1073 |
| 388 | G3459 | PRT | *Glycine max* | Functionally related and homologous to G1073 |
| 389 | G3460 | DNA | *Glycine max* | Predicted polypeptide sequence is functionally related and homologous to G1073 |
| 390 | G3460 | PRT | *Glycine max* | Functionally related and homologous to G1073 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| 391 | G3462 | DNA | *Glycine max* | Predicted polypeptide sequence is orthologous to G1073 |
| 392 | G3462 | PRT | *Glycine max* | Orthologous to G1073 |
| 393 | G3470 | DNA | *Glycine max* | Predicted polypeptide sequence is orthologous to G481 and G482 |
| 394 | G3470 | PRT | *Glycine max* | Orthologous to G481 and G482 |
| 395 | G3471 | DNA | *Glycine max* | Predicted polypeptide sequence is orthologous to G481 and G482 |
| 396 | G3471 | PRT | *Glycine max* | Orthologous to G481 and G482 |
| 397 | G3472 | DNA | *Glycine max* | Predicted polypeptide sequence is orthologous to G481 and G482 |
| 398 | G3472 | PRT | *Glycine max* | Orthologous to G481 and G482 |
| 399 | G3473 | DNA | *Glycine max* | Predicted polypeptide sequence is orthologous to G481 and G482 |
| 400 | G3473 | PRT | *Glycine max* | Orthologous to G481 and G482 |
| 401 | G3474 | DNA | *Glycine max* | Predicted polypeptide sequence is orthologous to G481 and G482 |
| 402 | G3474 | PRT | *Glycine max* | Orthologous to G481 and G482 |
| 403 | G3475 | DNA | *Glycine max* | Predicted polypeptide sequence is orthologous to G481 and G482 |
| 404 | G3475 | PRT | *Glycine max* | Orthologous to G481 and G482 |
| 405 | G3476 | DNA | *Glycine max* | Predicted polypeptide sequence is orthologous to G481 and G482 |
| 406 | G3476 | PRT | *Glycine max* | Orthologous to G481 and G482 |
| 407 | G3477 | DNA | *Glycine max* | Predicted polypeptide sequence is orthologous to G481 and G482 |
| 408 | G3477 | PRT | *Glycine max* | Orthologous to G481 and G482 |
| 409 | G3478 | DNA | *Glycine max* | Predicted polypeptide sequence is orthologous to G481 and G482 |
| 410 | G3478 | PRT | *Glycine max* | Orthologous to G481 and G482 |
| 411 | G3556 | DNA | *Oryza sativa* | Predicted polypeptide sequence is orthologous to G1073 |
| 412 | G3556 | PRT | *Oryza sativa* | Orthologous to G1073 |
| 413 | G3835 | DNA | *Oryza sativa* | Predicted polypeptide sequence is orthologous to G481 and G482 |
| 414 | G3835 | PRT | *Oryza sativa* | Orthologous to G481 and G482 |
| 415 | G3836 | DNA | *Oryza sativa* | Predicted polypeptide sequence is orthologous to G481 and G482 |
| 416 | G3836 | PRT | *Oryza sativa* | Orthologous to G481 and G482 |
| 417 | G3837 | DNA | *Glycine max* | Predicted polypeptide sequence is orthologous to G481 and G482 |
| 418 | G3837 | PRT | *Glycine max* | Orthologous to G481 and G482 |
| 419 | G24 | DNA | *Arabidopsis thaliana* | Predicted polypeptide sequence is paralogous to G12, G1277, G1379; orthologous to G3656 |
| 420 | G24 | PRT | *Arabidopsis thaliana* | Paralogous to G12, G1277, G1379; orthologous to G3656 |
| 421 | G154 | DNA | *Arabidopsis thaliana* | Predicted polypeptide sequence is paralogous to G1011 |
| 422 | G154 | PRT | *Arabidopsis thaliana* | Paralogous to G1011 |
| 423 | G384 | DNA | *Arabidopsis thaliana* | Predicted polypeptide sequence is paralogous to G1588, G385 |
| 424 | G384 | PRT | *Arabidopsis thaliana* | Paralogous to G1588, G385 |
| 425 | G545 | DNA | *Arabidopsis thaliana* | Predicted polypeptide sequence is paralogous to G350, G351 |
| 426 | G545 | PRT | *Arabidopsis thaliana* | Paralogous to G350, G351 |
| 427 | G760 | DNA | *Arabidopsis thaliana* | Predicted polypeptide sequence is paralogous to G3041 |
| 428 | G760 | PRT | *Arabidopsis thaliana* | Paralogous to G3041 |
| 429 | G773 | DNA | *Arabidopsis thaliana* | Predicted polypeptide sequence is paralogous to G1412, G759 |
| 430 | G773 | PRT | *Arabidopsis thaliana* | Paralogous to G1412, G759 |
| 433 | G971 | DNA | *Arabidopsis thaliana* | Predicted polypeptide sequence is paralogous to G914 |
| 434 | G971 | PRT | *Arabidopsis thaliana* | Paralogous to G914 |
| 435 | G988 | DNA | *Arabidopsis thaliana* | |
| 436 | G988 | PRT | *Arabidopsis thaliana* | |
| 441 | G1322 | DNA | *Arabidopsis thaliana* | Predicted polypeptide sequence is paralogous to G221, G249 |
| 442 | G1322 | PRT | *Arabidopsis thaliana* | Paralogous to G221, G249 |
| 449 | G1818 | DNA | *Arabidopsis thaliana* | Predicted polypeptide sequence is paralogous to G1836 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| 450 | G1818 | PRT | *Arabidopsis thaliana* | Paralogous to G1836 |
| 451 | G1868 | DNA | *Arabidopsis thaliana* | Predicted polypeptide sequence is paralogous to G1439 |
| 452 | G1868 | PRT | *Arabidopsis thaliana* | Paralogous to G1439 |
| 453 | G1888 | DNA | *Arabidopsis thaliana* | Predicted polypeptide sequence is paralogous to G1482 |
| 454 | G1888 | PRT | *Arabidopsis thaliana* | Paralogous to G1482 |
| 457 | G2131 | DNA | *Arabidopsis thaliana* | Predicted polypeptide sequence is paralogous to G2106, G979 |
| 458 | G2131 | PRT | *Arabidopsis thaliana* | Paralogous to G2106, G979 |
| 461 | G2522 | DNA | *Arabidopsis thaliana* | Predicted polypeptide sequence is paralogous to G1071 |
| 462 | G2522 | PRT | *Arabidopsis thaliana* | Paralogous to G1071 |
| 465 | G27 | DNA | *Arabidopsis thaliana* | Predicted polypeptide sequence is paralogous to G1386, G441 |
| 466 | G27 | PRT | *Arabidopsis thaliana* | Paralogous to G1386, G441 |
| 471 | G168 | DNA | *Arabidopsis thaliana* | Predicted polypeptide sequence is paralogous to G170, G2065 |
| 472 | G168 | PRT | *Arabidopsis thaliana* | Paralogous to G170, G2065 |
| 479 | G234 | DNA | *Arabidopsis thaliana* | Predicted polypeptide sequence is paralogous to G232 |
| 480 | G234 | PRT | *Arabidopsis thaliana* | Paralogous to G232 |
| 481 | G237 | DNA | *Arabidopsis thaliana* | Predicted polypeptide sequence is paralogous to G1309 |
| 482 | G237 | PRT | *Arabidopsis thaliana* | Paralogous to G1309 |
| 483 | G275 | DNA | *Arabidopsis thaliana* | Predicted polypeptide sequence is paralogous to G829, G837 |
| 484 | G275 | PRT | *Arabidopsis thaliana* | Paralogous to G829, G837 |
| 485 | G326 | DNA | *Arabidopsis thaliana* | Predicted polypeptide sequence is paralogous to G1337 |
| 486 | G326 | PRT | *Arabidopsis thaliana* | Paralogous to G1337 |
| 489 | G427 | DNA | *Arabidopsis thaliana* | Predicted polypeptide sequence is paralogous to G2545, G425, G426 |
| 490 | G427 | PRT | *Arabidopsis thaliana* | Paralogous to G2545, G425, G426 |
| 495 | G602 | DNA | *Arabidopsis thaliana* | Predicted polypeptide sequence is paralogous to G1065 |
| 496 | G602 | PRT | *Arabidopsis thaliana* | Paralogous to G1065 |
| 497 | G618 | DNA | *Arabidopsis thaliana* | Predicted polypeptide sequence is paralogous to G2057 |
| 498 | G618 | PRT | *Arabidopsis thaliana* | Paralogous to G2057 |
| 503 | G653 | DNA | *Arabidopsis thaliana* | Predicted polypeptide sequence is paralogous to G654 |
| 504 | G653 | PRT | *Arabidopsis thaliana* | Paralogous to G654 |
| 507 | G837 | DNA | *Arabidopsis thaliana* | Predicted polypeptide sequence is paralogous to G275, G829 |
| 508 | G837 | PRT | *Arabidopsis thaliana* | Paralogous to G275, G829 |
| 509 | G866 | DNA | *Arabidopsis thaliana* | Predicted polypeptide sequence is paralogous to G883 |
| 510 | G866 | PRT | *Arabidopsis thaliana* | Paralogous to G883 |
| 511 | G872 | DNA | *Arabidopsis thaliana* | Predicted polypeptide sequence is paralogous to G2576; orthologous to G3652, G3653, G3654, G3655 |
| 512 | G872 | PRT | *Arabidopsis thaliana* | Paralogous to G2576; orthologous to G3652, G3653, G3654, G3655 |
| 515 | G912 | DNA | *Arabidopsis thaliana* | Predicted polypeptide sequence is paralogous to G40, G2107, G2513, G41, G42; orthologous to G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3463, G3464, G3465, G3466, G3467, G3468, G3469 |
| 516 | G912 | PRT | *Arabidopsis thaliana* | Paralogous to G40, G2107, G2513, G41, G42; orthologous to G3362, G3364, G3365, G3366, G3367, G3368, G3370, G3371, G3372, G3373, G3374, G3375, G3376, G3377, G3378, G3379, G3438, G3439, G3440, G3441, G3442, |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| | | | | G3369, G3497, G3498, G3499, G3463, G3464, G3465, G3466, G3467, G3468, G3469 |
| 517 | G932 | DNA | *Arabidopsis thaliana* | Predicted polypeptide sequence is paralogous to G256, G666, G668; orthologous to G3384, G3385, G3386, G3500, G3501, G3502, G3537, G3538, G3539, G3540, G3541 |
| 518 | G932 | PRT | *Arabidopsis thaliana* | Paralogous to G256, G666, G668; orthologous to G3384, G3385, G3386, G3500, G3501, G3502, G3537, G3538, G3539, G3540, G3541 |
| 519 | G958 | DNA | *Arabidopsis thaliana* | Predicted polypeptide sequence is paralogous to G2180, G518 |
| 520 | G958 | PRT | *Arabidopsis thaliana* | Paralogous to G2180, G518 |
| 521 | G964 | DNA | *Arabidopsis thaliana* | Predicted polypeptide sequence is paralogous to G398, G399 |
| 522 | G964 | PRT | *Arabidopsis thaliana* | Paralogous to G398, G399 |
| 523 | G979 | DNA | *Arabidopsis thaliana* | Predicted polypeptide sequence is paralogous to G2106, G2131 |
| 524 | G979 | PRT | *Arabidopsis thaliana* | Paralogous to G2106, G2131 |
| 525 | G1049 | DNA | *Arabidopsis thaliana* | Predicted polypeptide sequence is paralogous to G572 |
| 526 | G1049 | PRT | *Arabidopsis thaliana* | Paralogous to G572 |
| 529 | G1255 | DNA | *Arabidopsis thaliana* | Predicted polypeptide sequence is paralogous to G1484 |
| 530 | G1255 | PRT | *Arabidopsis thaliana* | Paralogous to G1484 |
| 537 | G1494 | DNA | *Arabidopsis thaliana* | Predicted polypeptide sequence is paralogous to G789 |
| 538 | G1494 | PRT | *Arabidopsis thaliana* | Paralogous to G789 |
| 539 | G1535 | DNA | *Arabidopsis thaliana* | Predicted polypeptide sequence is paralogous to G389 |
| 540 | G1535 | PRT | *Arabidopsis thaliana* | Paralogous to G389 |
| 543 | G1750 | DNA | *Arabidopsis thaliana* | Predicted polypeptide sequence is paralogous to G864, G440 |
| 544 | G1750 | PRT | *Arabidopsis thaliana* | Paralogous to G864, G440 |
| 549 | G1930 | DNA | *Arabidopsis thaliana* | Predicted polypeptide sequence is paralogous to G867, G9, G993; orthologous to G3388, G3389, G3390, G3391, G3432, G3433, G3451, G3452, G3453, G3454 |
| 550 | G1930 | PRT | *Arabidopsis thaliana* | Paralogous to G867, G9, G993; orthologous to G3388, G3389, G3390, G3391, G3432, G3433, G3451, G3452, G3453, G3454 |
| 551 | G2057 | DNA | *Arabidopsis thaliana* | Predicted polypeptide sequence is paralogous to G618 |
| 552 | G2057 | PRT | *Arabidopsis thaliana* | Paralogous to G618 |
| 553 | G2144 | DNA | *Arabidopsis thaliana* | Predicted polypeptide sequence is paralogous to G1942 |
| 554 | G2144 | PRT | *Arabidopsis thaliana* | Paralogous to G1942 |
| 555 | G2145 | DNA | *Arabidopsis thaliana* | Predicted polypeptide sequence is paralogous to G2148 |
| 556 | G2145 | PRT | *Arabidopsis thaliana* | Paralogous to G2148 |
| 559 | G2512 | DNA | *Arabidopsis thaliana* | Predicted polypeptide sequence is paralogous to G1752 |
| 560 | G2512 | PRT | *Arabidopsis thaliana* | Paralogous to G1752 |
| 563 | G2535 | DNA | *Arabidopsis thaliana* | Predicted polypeptide sequence is paralogous to G957, G961 |
| 564 | G2535 | PRT | *Arabidopsis thaliana* | Paralogous to G957, G961 |
| 567 | G2719 | DNA | *Arabidopsis thaliana* | Predicted polypeptide sequence is paralogous to G216 |
| 568 | G2719 | PRT | *Arabidopsis thaliana* | Paralogous to G216 |
| 569 | G9 | DNA | *Arabidopsis thaliana* | Predicted polypeptide sequence is paralogous to G1930, G867, G993; orthologous to G3388, G3389, G3390, G3391, G3432, G3433, G3451, G3452, G3453, G3454 |
| 570 | G9 | PRT | *Arabidopsis thaliana* | Paralogous to G1930, G867, G993; orthologous to G3388, G3389, G3390, G3391, G3432, G3433, G3451, G3452, G3453, G3454 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| 571 | G12 | DNA | *Arabidopsis thaliana* | Predicted polypeptide sequence is paralogous to G1277, G1379, G24; orthologous to G3656 |
| 572 | G12 | PRT | *Arabidopsis thaliana* | Paralogous to G1277, G1379, G24; orthologous to G3656 |
| 573 | G40 | DNA | *Arabidopsis thaliana* | Predicted polypeptide sequence is paralogous to G2107, G2513, G41, G42, G912; orthologous to G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3463, G3464, G3465, G3466, G3467, G3468, G3469 |
| 574 | G40 | PRT | *Arabidopsis thaliana* | Paralogous to G2107, G2513, G41, G42, G912; orthologous to G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3463, G3464, G3465, G3466, G3467, G3468, G3469 |
| 575 | G41 | DNA | *Arabidopsis thaliana* | Predicted polypeptide sequence is paralogous to G40, G2107, G2513, G42, G912; orthologous to G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3463, G3464, G3465, G3466, G3467, G3468, G3469 |
| 576 | G41 | PRT | *Arabidopsis thaliana* | Paralogous to G40, G2107, G2513, G42, G912; orthologous to G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3463, G3464, G3465, G3466, G3467, G3468, G3469 |
| 577 | G42 | DNA | *Arabidopsis thaliana* | Predicted polypeptide sequence is paralogous to G40, G2107, G2513, G41, G912; orthologous to G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3463, G3464, G3465, G3466, G3467, G3468, G3469 |
| 578 | G42 | PRT | *Arabidopsis thaliana* | Paralogous to G40, G2107, G2513, G41, G912; orthologous to G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3463, G3464, G3465, G3466, G3467, G3468, G3469 |
| 579 | G170 | DNA | *Arabidopsis thaliana* | Predicted polypeptide sequence is paralogous to G168, G2065 |
| 580 | G170 | PRT | *Arabidopsis thaliana* | Paralogous to G168, G2065 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| 581 | G216 | DNA | *Arabidopsis thaliana* | Predicted polypeptide sequence is paralogous to G2719 |
| 582 | G216 | PRT | *Arabidopsis thaliana* | Paralogous to G2719 |
| 583 | G221 | DNA | *Arabidopsis thaliana* | Predicted polypeptide sequence is paralogous to G1322, G249 |
| 584 | G221 | PRT | *Arabidopsis thaliana* | Paralogous to G1322, G249 |
| 585 | G232 | DNA | *Arabidopsis thaliana* | Predicted polypeptide sequence is paralogous to G234 |
| 586 | G232 | PRT | *Arabidopsis thaliana* | Paralogous to G234 |
| 587 | G249 | DNA | *Arabidopsis thaliana* | Predicted polypeptide sequence is paralogous to G1322, G221 |
| 588 | G249 | PRT | *Arabidopsis thaliana* | Paralogous to G1322, G221 |
| 589 | G256 | DNA | *Arabidopsis thaliana* | Predicted polypeptide sequence is paralogous to G666, G668, G932; orthologous to G3384, G3385, G3386, G3500, G3501, G3502, G3537, G3538, G3539, G3540, G3541 |
| 590 | G256 | PRT | *Arabidopsis thaliana* | Paralogous to G666, G668, G932; orthologous to G3384, G3385, G3386, G3500, G3501, G3502, G3537, G3538, G3539, G3540, G3541 |
| 591 | G350 | DNA | *Arabidopsis thaliana* | Predicted polypeptide sequence is paralogous to G351, G545 |
| 592 | G350 | PRT | *Arabidopsis thaliana* | Paralogous to G351, G545 |
| 593 | G351 | DNA | *Arabidopsis thaliana* | Predicted polypeptide sequence is paralogous to G350, G545 |
| 594 | G351 | PRT | *Arabidopsis thaliana* | Paralogous to G350, G545 |
| 595 | G385 | DNA | *Arabidopsis thaliana* | Predicted polypeptide sequence is paralogous to G1588, G384 |
| 596 | G385 | PRT | *Arabidopsis thaliana* | Paralogous to G1588, G384 |
| 597 | G389 | DNA | *Arabidopsis thaliana* | Predicted polypeptide sequence is paralogous to G1535 |
| 598 | G389 | PRT | *Arabidopsis thaliana* | Paralogous to G1535 |
| 599 | G398 | DNA | *Arabidopsis thaliana* | Predicted polypeptide sequence is paralogous to G399, G964 |
| 600 | G398 | PRT | *Arabidopsis thaliana* | Paralogous to G399, G964 |
| 601 | G399 | DNA | *Arabidopsis thaliana* | Predicted polypeptide sequence is paralogous to G398, G964 |
| 602 | G399 | PRT | *Arabidopsis thaliana* | Paralogous to G398, G964 |
| 603 | G425 | DNA | *Arabidopsis thaliana* | Predicted polypeptide sequence is paralogous to G2545, G426, G427 |
| 604 | G425 | PRT | *Arabidopsis thaliana* | Paralogous to G2545, G426, G427 |
| 605 | G426 | DNA | *Arabidopsis thaliana* | Predicted polypeptide sequence is paralogous to G2545, G425, G427 |
| 606 | G426 | PRT | *Arabidopsis thaliana* | Paralogous to G2545, G425, G427 |
| 607 | G440 | DNA | *Arabidopsis thaliana* | Predicted polypeptide sequence is paralogous to G864, G1750 |
| 608 | G440 | PRT | *Arabidopsis thaliana* | Paralogous to G864, G1750 |
| 609 | G441 | DNA | *Arabidopsis thaliana* | Predicted polypeptide sequence is paralogous to G1386, G27 |
| 610 | G441 | PRT | *Arabidopsis thaliana* | Paralogous to G1386, G27 |
| 611 | G518 | DNA | *Arabidopsis thaliana* | Predicted polypeptide sequence is paralogous to G2180, G958 |
| 612 | G518 | PRT | *Arabidopsis thaliana* | Paralogous to G2180, G958 |
| 613 | G572 | DNA | *Arabidopsis thaliana* | Predicted polypeptide sequence is paralogous to G1049 |
| 614 | G572 | PRT | *Arabidopsis thaliana* | Paralogous to G1049 |
| 615 | G654 | DNA | *Arabidopsis thaliana* | Predicted polypeptide sequence is paralogous to G653 |
| 616 | G654 | PRT | *Arabidopsis thaliana* | Paralogous to G653 |
| 617 | G666 | DNA | *Arabidopsis thaliana* | Predicted polypeptide sequence is paralogous to G256, G668, G932; orthologous to G3384, G3385, G3386, G3500, G3501, G3502, G3537, G3538, G3539, G3540, G3541 |
| 618 | G666 | PRT | *Arabidopsis thaliana* | Paralogous to G256, G668, G932; orthologous to G3384, G3385, G3386, G3500, G3501, G3502, G3537, G3538, G3539, G3540, G3541 |
| 619 | G668 | DNA | *Arabidopsis thaliana* | Predicted polypeptide sequence is paralogous to G256, G666, G932; orthologous to G3384, G3385, G3386, |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| 620 | G668 | PRT | *Arabidopsis thaliana* | G3500, G3501, G3502, G3537, G3538, G3539, G3540, G3541 Paralogous to G256, G666, G932; orthologous to G3384, G3385, G3386, G3500, G3501, G3502, G3537, G3538, G3539, G3540, G3541 |
| 621 | G759 | DNA | *Arabidopsis thaliana* | Predicted polypeptide sequence is paralogous to G1412, G773 |
| 622 | G759 | PRT | *Arabidopsis thaliana* | Paralogous to G1412, G773 |
| 623 | G789 | DNA | *Arabidopsis thaliana* | Predicted polypeptide sequence is paralogous to G1494 |
| 624 | G789 | PRT | *Arabidopsis thaliana* | Paralogous to G1494 |
| 625 | G829 | DNA | *Arabidopsis thaliana* | Predicted polypeptide sequence is paralogous to G275, G837 |
| 626 | G829 | PRT | *Arabidopsis thaliana* | Paralogous to G275, G837 |
| 627 | G864 | DNA | *Arabidopsis thaliana* | Predicted polypeptide sequence is paralogous to G1750, G440 |
| 628 | G864 | PRT | *Arabidopsis thaliana* | Paralogous to G1750, G440 |
| 629 | G867 | DNA | *Arabidopsis thaliana* | Predicted polypeptide sequence is paralogous to G1930, G9, G993; orthologous to G3388, G3389, G3390, G3391, G3432, G3433, G3451, G3452, G3453, G3454 |
| 630 | G867 | PRT | *Arabidopsis thaliana* | Paralogous to G1930, G9, G993; orthologous to G3388, G3389, G3390, G3391, G3432, G3433, G3451, G3452, G3453, G3454 |
| 631 | G883 | DNA | *Arabidopsis thaliana* | Predicted polypeptide sequence is paralogous to G866 |
| 632 | G883 | PRT | *Arabidopsis thaliana* | Paralogous to G866 |
| 633 | G914 | DNA | *Arabidopsis thaliana* | Predicted polypeptide sequence is paralogous to G971 |
| 634 | G914 | PRT | *Arabidopsis thaliana* | Paralogous to G971 |
| 635 | G957 | DNA | *Arabidopsis thaliana* | Predicted polypeptide sequence is paralogous to G2535, G961 |
| 636 | G957 | PRT | *Arabidopsis thaliana* | Paralogous to G2535, G961 |
| 637 | G961 | DNA | *Arabidopsis thaliana* | Predicted polypeptide sequence is paralogous to G2535, G957 |
| 638 | G961 | PRT | *Arabidopsis thaliana* | Paralogous to G2535, G957 |
| 639 | G993 | DNA | *Arabidopsis thaliana* | Predicted polypeptide sequence is paralogous to G1930, G867, G9; orthologous to G3388, G3389, G3390, G3391, G3432, G3433, G3451, G3452, G3453, G3454 |
| 640 | G993 | PRT | *Arabidopsis thaliana* | Paralogous to G1930, G867, G9; orthologous to G3388, G3389, G3390, G3391, G3432, G3433, G3451, G3452, G3453, G3454 |
| 641 | G1011 | DNA | *Arabidopsis thaliana* | Predicted polypeptide sequence is paralogous to G154 |
| 642 | G1011 | PRT | *Arabidopsis thaliana* | Paralogous to G154 |
| 643 | G1065 | DNA | *Arabidopsis thaliana* | Predicted polypeptide sequence is paralogous to G602 |
| 644 | G1065 | PRT | *Arabidopsis thaliana* | Paralogous to G602 |
| 645 | G1071 | DNA | *Arabidopsis thaliana* | Predicted polypeptide sequence is paralogous to G2522 |
| 646 | G1071 | PRT | *Arabidopsis thaliana* | Paralogous to G2522 |
| 647 | G1277 | DNA | *Arabidopsis thaliana* | Predicted polypeptide sequence is paralogous to G12, G1379, G24; orthologous to G3656 |
| 648 | G1277 | PRT | *Arabidopsis thaliana* | Paralogous to G12, G1379, G24; orthologous to G3656 |
| 649 | G1309 | DNA | *Arabidopsis thaliana* | Predicted polypeptide sequence is paralogous to G237 |
| 650 | G1309 | PRT | *Arabidopsis thaliana* | Paralogous to G237 |
| 651 | G1337 | DNA | *Arabidopsis thaliana* | Predicted polypeptide sequence is paralogous to G326 |
| 652 | G1337 | PRT | *Arabidopsis thaliana* | Paralogous to G326 |
| 653 | G1379 | DNA | *Arabidopsis thaliana* | Predicted polypeptide sequence is paralogous to G12, G1277, G24; orthologous to G3656 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| 654 | G1379 | PRT | *Arabidopsis thaliana* | Paralogous to G12, G1277, G24; orthologous to G3656 |
| 655 | G1386 | DNA | *Arabidopsis thaliana* | Predicted polypeptide sequence is paralogous to G27, G441 |
| 656 | G1386 | PRT | *Arabidopsis thaliana* | Paralogous to G27, G441 |
| 657 | G1412 | DNA | *Arabidopsis thaliana* | Predicted polypeptide sequence is paralogous to G759, G773 |
| 658 | G1412 | PRT | *Arabidopsis thaliana* | Paralogous to G759, G773 |
| 659 | G1439 | DNA | *Arabidopsis thaliana* | Predicted polypeptide sequence is paralogous to G1868 |
| 660 | G1439 | PRT | *Arabidopsis thaliana* | Paralogous to G1868 |
| 661 | G1482 | DNA | *Arabidopsis thaliana* | Predicted polypeptide sequence is paralogous to G1888 |
| 662 | G1482 | PRT | *Arabidopsis thaliana* | Paralogous to G1888 |
| 663 | G1484 | DNA | *Arabidopsis thaliana* | Predicted polypeptide sequence is paralogous to G1255 |
| 664 | G1484 | PRT | *Arabidopsis thaliana* | Paralogous to G1255 |
| 665 | G1588 | DNA | *Arabidopsis thaliana* | Predicted polypeptide sequence is paralogous to G384, G385 |
| 666 | G1588 | PRT | *Arabidopsis thaliana* | Paralogous to G384, G385 |
| 667 | G1752 | DNA | *Arabidopsis thaliana* | Predicted polypeptide sequence is paralogous to G2512 |
| 668 | G1752 | PRT | *Arabidopsis thaliana* | Paralogous to G2512 |
| 669 | G1836 | DNA | *Arabidopsis thaliana* | Predicted polypeptide sequence is paralogous to G1818 |
| 670 | G1836 | PRT | *Arabidopsis thaliana* | Paralogous to G1818 |
| 671 | G1942 | DNA | *Arabidopsis thaliana* | Predicted polypeptide sequence is paralogous to G2144 |
| 672 | G1942 | PRT | *Arabidopsis thaliana* | Paralogous to G2144 |
| 673 | G2065 | DNA | *Arabidopsis thaliana* | Predicted polypeptide sequence is paralogous to G168, G170 |
| 674 | G2065 | PRT | *Arabidopsis thaliana* | Paralogous to G168, G170 |
| 675 | G2106 | DNA | *Arabidopsis thaliana* | Predicted polypeptide sequence is paralogous to G2131, G979 |
| 676 | G2106 | PRT | *Arabidopsis thaliana* | Paralogous to G2131, G979 |
| 677 | G2107 | DNA | *Arabidopsis thaliana* | Predicted polypeptide sequence is paralogous to G40, G2513, G41, G42, G912; orthologous to G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3463, G3464, G3465, G3466, G3467, G3468, G3469 |
| 678 | G2107 | PRT | *Arabidopsis thaliana* | Paralogous to G40, G2513, G41, G42, G912; orthologous to G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3463, G3464, G3465, G3466, G3467, G3468, G3469 |
| 679 | G2148 | DNA | *Arabidopsis thaliana* | Predicted polypeptide sequence is paralogous to G2145 |
| 680 | G2148 | PRT | *Arabidopsis thaliana* | Paralogous to G2145 |
| 681 | G2180 | DNA | *Arabidopsis thaliana* | Predicted polypeptide sequence is paralogous to G518, G958 |
| 682 | G2180 | PRT | *Arabidopsis thaliana* | Paralogous to G518, G958 |
| 683 | G2513 | DNA | *Arabidopsis thaliana* | Predicted polypeptide sequence is paralogous to G40, G2107, G41, G42, G912; orthologous to G3362, G3364, G3365, G3366, G3367, G3368, G3370, G3371, G3372, G3373, G3374, G3375, G3376, G3377, G3378, G3379, G3438, G3439, G3440, G3441, G3442, G3369, |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| | | | | G3497, G3498, G3499, G3463, G3464, G3465, G3466, G3467, G3468, G3469 |
| 684 | G2513 | PRT | *Arabidopsis thaliana* | Paralogous to G40, G2107, G41, G42, G912; orthologous to G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499, G3463, G3464, G3465, G3466, G3467, G3468, G3469 |
| 685 | G2545 | DNA | *Arabidopsis thaliana* | Predicted polypeptide sequence is paralogous to G425, G426, G427 |
| 686 | G2545 | PRT | *Arabidopsis thaliana* | Paralogous to G425, G426, G427 |
| 687 | G2576 | DNA | *Arabidopsis thaliana* | Predicted polypeptide sequence is paralogous to G872; orthologous to G3652, G3653, G3654, G3655 |
| 688 | G2576 | PRT | *Arabidopsis thaliana* | Paralogous to G872; orthologous to G3652, G3653, G3654, G3655 |
| 689 | G3041 | DNA | *Arabidopsis thaliana* | Predicted polypeptide sequence is paralogous to G760 |
| 690 | G3041 | PRT | *Arabidopsis thaliana* | Paralogous to G760 |
| 691 | G3362 | DNA | *Medicago truncatula* | Predicted polypeptide sequence is paralogous to G3364, G3365, G3366, G3367, G3368, G3369; orthologous to G40, G2107, G2513, G41, G42, G912, G3370, G3371, G3372, G3373, G3374, G3375, G3376, G3377, G3378, G3379, G3438, G3439, G3440, G3441, G3442, G3497, G3498, G3499, G3463, G3464, G3465, G3466, G3467, G3468, G3469 |
| 692 | G3362 | PRT | *Medicago truncatula* | Paralogous to G3364, G3365, G3366, G3367, G3368, G3369; orthologous to G40, G2107, G2513, G41, G42, G912, G3370, G3371, G3372, G3373, G3374, G3375, G3376, G3377, G3378, G3379, G3438, G3439, G3440, G3441, G3442, G3497, G3498, G3499, G3463, G3464, G3465, G3466, G3467, G3468, G3469 |
| 693 | G3364 | DNA | *Medicago truncatula* | Predicted polypeptide sequence is paralogous to G3362, G3365, G3366, G3367, G3368, G3369; orthologous to G40, G2107, G2513, G41, G42, G912, G3370, G3371, G3372, G3373, G3374, G3375, G3376, G3377, G3378, G3379, G3438, G3439, G3440, G3441, G3442, G3497, G3498, G3499, G3463, G3464, G3465, G3466, G3467, G3468, G3469 |
| 694 | G3364 | PRT | *Medicago truncatula* | Paralogous to G3362, G3365, G3366, G3367, G3368, G3369; orthologous to G40, G2107, G2513, G41, G42, G912, G3370, G3371, G3372, G3373, G3374, G3375, G3376, G3377, G3378, G3379, G3438, G3439, G3440, G3441, G3442, G3497, G3498, G3499, G3463, G3464, G3465, G3466, G3467, G3468, G3469 |
| 695 | G3365 | DNA | *Medicago truncatula* | Predicted polypeptide sequence is paralogous to G3362, G3364, G3366, G3367, G3368, G3369; orthologous to G40, G2107, G2513, G41, G42, G912, G3370, G3371, G3372, G3373, G3374, G3375, G3376, G3377, |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| | | | | G3378, G3379, G3438, G3439, G3440, G3441, G3442, G3497, G3498, G3499, G3463, G3464, G3465, G3466, G3467, G3468, G3469 |
| 696 | G3365 | PRT | *Medicago truncatula* | Paralogous to G3362, G3364, G3366, G3367, G3368, G3369; orthologous to G40, G2107, G2513, G41, G42, G912, G3370, G3371, G3372, G3373, G3374, G3375, G3376, G3377, G3378, G3379, G3438, G3439, G3440, G3441, G3442, G3497, G3498, G3499, G3463, G3464, G3465, G3466, G3467, G3468, G3469 |
| 697 | G3366 | DNA | *Medicago truncatula* | Predicted polypeptide sequence is paralogous to G3362, G3364, G3365, G3367, G3368, G3369; orthologous to G40, G2107, G2513, G41, G42, G912, G3370, G3371, G3372, G3373, G3374, G3375, G3376, G3377, G3378, G3379, G3438, G3439, G3440, G3441, G3442, G3497, G3498, G3499, G3463, G3464, G3465, G3466, G3467, G3468, G3469 |
| 698 | G3366 | PRT | *Medicago truncatula* | Paralogous to G3362, G3364, G3365, G3367, G3368, G3369; orthologous to G40, G2107, G2513, G41, G42, G912, G3370, G3371, G3372, G3373, G3374, G3375, G3376, G3377, G3378, G3379, G3438, G3439, G3440, G3441, G3442, G3497, G3498, G3499, G3463, G3464, G3465, G3466, G3467, G3468, G3469 |
| 699 | G3367 | DNA | *Medicago truncatula* | Predicted polypeptide sequence is paralogous to G3362, G3364, G3365, G3366, G3368, G3369; orthologous to G40, G2107, G2513, G41, G42, G912, G3370, G3371, G3372, G3373, G3374, G3375, G3376, G3377, G3378, G3379, G3438, G3439, G3440, G3441, G3442, G3497, G3498, G3499, G3463, G3464, G3465, G3466, G3467, G3468, G3469 |
| 700 | G3367 | PRT | *Medicago truncatula* | Paralogous to G3362, G3364, G3365, G3366, G3368, G3369; orthologous to G40, G2107, G2513, G41, G42, G912, G3370, G3371, G3372, G3373, G3374, G3375, G3376, G3377, G3378, G3379, G3438, G3439, G3440, G3441, G3442, G3497, G3498, G3499, G3463, G3464, G3465, G3466, G3467, G3468, G3469 |
| 701 | G3368 | DNA | *Medicago truncatula* | Predicted polypeptide sequence is paralogous to G3362, G3364, G3365, G3366, G3367, G3369; orthologous to G40, G2107, G2513, G41, G42, G912, G3370, G3371, G3372, G3373, G3374, G3375, G3376, G3377, G3378, G3379, G3438, G3439, G3440, G3441, G3442, G3497, G3498, G3499, G3463, G3464, G3465, G3466, G3467, G3468, G3469 |
| 702 | G3368 | PRT | *Medicago truncatula* | Paralogous to G3362, G3364, G3365, G3366, G3367, G3369; orthologous to G40, G2107, G2513, G41, G42, G912, G3370, G3371, G3372, G3373, |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| | | | | G3374, G3375, G3376, G3377, G3378, G3379, G3438, G3439, G3440, G3441, G3442, G3497, G3498, G3499, G3463, G3464, G3465, G3466, G3467, G3468, G3469 |
| 703 | G3369 | DNA | *Medicago truncatula* | Predicted polypeptide sequence is paralogous to G3362, G3364, G3365, G3366, G3367, G3368; orthologous to G40, G2107, G2513, G41, G42, G912, G3370, G3371, G3372, G3373, G3374, G3375, G3376, G3377, G3378, G3379, G3438, G3439, G3440, G3441, G3442, G3497, G3498, G3499, G3463, G3464, G3465, G3466, G3467, G3468, G3469 |
| 704 | G3369 | PRT | *Medicago truncatula* | Paralogous to G3362, G3364, G3365, G3366, G3367, G3368; orthologous to G40, G2107, G2513, G41, G42, G912, G3370, G3371, G3372, G3373, G3374, G3375, G3376, G3377, G3378, G3379, G3438, G3439, G3440, G3441, G3442, G3497, G3498, G3499, G3463, G3464, G3465, G3466, G3467, G3468, G3469 |
| 705 | G3370 | DNA | *Oryza sativa* | Predicted polypeptide sequence is paralogous to G3371, G3374, G3376, G3378; orthologous to G40, G2107, G2513, G41, G42, G912, G3362, G3364, G3365, G3366, G3367, G3368, G3372, G3373, G3375, G3377, G3379, G3438, G3439, G3440, G3441, G3442, G3369, G3497, G3498, G3499, G3463, G3464, G3465, G3466, G3467, G3468, G3469 |
| 706 | G3370 | PRT | *Oryza sativa* | Paralogous to G3371, G3374, G3376, G3378; orthologous to G40, G2107, G2513, G41, G42, G912, G3362, G3364, G3365, G3366, G3367, G3368, G3372, G3373, G3375, G3377, G3379, G3438, G3439, G3440, G3441, G3442, G3369, G3497, G3498, G3499, G3463, G3464, G3465, G3466, G3467, G3468, G3469 |
| 707 | G3371 | DNA | *Oryza sativa* | Predicted polypeptide sequence is paralogous to G3370, G3374, G3376, G3378; orthologous to G40, G2107, G2513, G41, G42, G912, G3362, G3364, G3365, G3366, G3367, G3368, G3372, G3373, G3375, G3377, G3379, G3438, G3439, G3440, G3441, G3442, G3369, G3497, G3498, G3499, G3463, G3464, G3465, G3466, G3467, G3468, G3469 |
| 708 | G3371 | PRT | *Oryza sativa* | Paralogous to G3370, G3374, G3376, G3378; orthologous to G40, G2107, G2513, G41, G42, G912, G3362, G3364, G3365, G3366, G3367, G3368, G3372, G3373, G3375, G3377, G3379, G3438, G3439, G3440, G3441, G3442, G3369, G3497, G3498, G3499, G3463, G3464, G3465, G3466, G3467, G3468, G3469 |
| 709 | G3372 | DNA | *Oryza sativa* | Predicted polypeptide sequence is paralogous to G3373, G3375, G3377, G3379; orthologous to G40, G2107, |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| | | | | G2513, G41, G42, G912, G3362, G3364, G3365, G3366, G3367, G3368, G3370, G3371, G3374, G3376, G3378, G3438, G3439, G3440, G3441, G3442, G3369, G3497, G3498, G3499, G3463, G3464, G3465, G3466, G3467, G3468, G3469 |
| 710 | G3372 | PRT | *Oryza sativa* | Paralogous to G3373, G3375, G3377, G3379; orthologous to G40, G2107, G2513, G41, G42, G912, G3362, G3364, G3365, G3366, G3367, G3368, G3370, G3371, G3374, G3376, G3378, G3438, G3439, G3440, G3441, G3442, G3369, G3497, G3498, G3499, G3463, G3464, G3465, G3466, G3467, G3468, G3469 |
| 711 | G3373 | DNA | *Oryza sativa* | Predicted polypeptide sequence is paralogous to G3372, G3375, G3377, G3379; orthologous to G40, G2107, G2513, G41, G42, G912, G3362, G3364, G3365, G3366, G3367, G3368, G3370, G3371, G3374, G3376, G3378, G3438, G3439, G3440, G3441, G3442, G3369, G3497, G3498, G3499, G3463, G3464, G3465, G3466, G3467, G3468, G3469 |
| 712 | G3373 | PRT | *Oryza sativa* | Paralogous to G3372, G3375, G3377, G3379; orthologous to G40, G2107, G2513, G41, G42, G912, G3362, G3364, G3365, G3366, G3367, G3368, G3370, G3371, G3374, G3376, G3378, G3438, G3439, G3440, G3441, G3442, G3369, G3497, G3498, G3499, G3463, G3464, G3465, G3466, G3467, G3468, G3469 |
| 713 | G3374 | DNA | *Oryza sativa* | Predicted polypeptide sequence is paralogous to G3370, G3371, G3376, G3378; orthologous to G40, G2107, G2513, G41, G42, G912, G3362, G3364, G3365, G3366, G3367, G3368, G3372, G3373, G3375, G3377, G3379, G3438, G3439, G3440, G3441, G3442, G3369, G3497, G3498, G3499, G3463, G3464, G3465, G3466, G3467, G3468, G3469 |
| 714 | G3374 | PRT | *Oryza sativa* | Paralogous to G3370, G3371, G3376, G3378; orthologous to G40, G2107, G2513, G41, G42, G912, G3362, G3364, G3365, G3366, G3367, G3368, G3372, G3373, G3375, G3377, G3379, G3438, G3439, G3440, G3441, G3442, G3369, G3497, G3498, G3499, G3463, G3464, G3465, G3466, G3467, G3468, G3469 |
| 715 | G3375 | DNA | *Oryza sativa* | Predicted polypeptide sequence is paralogous to G3372, G3373, G3377, G3379; orthologous to G40, G2107, G2513, G41, G42, G912, G3362, G3364, G3365, G3366, G3367, G3368, G3370, G3371, G3374, G3376, G3378, G3438, G3439, G3440, G3441, G3442, G3369, G3497, G3498, G3499, G3463, G3464, G3465, G3466, G3467, G3468, G3469 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| 716 | G3375 | PRT | *Oryza sativa* | Paralogous to G3372, G3373, G3377, G3379; orthologous to G40, G2107, G2513, G41, G42, G912, G3362, G3364, G3365, G3366, G3367, G3368, G3370, G3371, G3374, G3376, G3378, G3438, G3439, G3440, G3441, G3442, G3369, G3497, G3498, G3499, G3463, G3464, G3465, G3466, G3467, G3468, G3469 |
| 717 | G3376 | DNA | *Oryza sativa* | Predicted polypeptide sequence is paralogous to G3370, G3371, G3374, G3378; orthologous to G40, G2107, G2513, G41, G42, G912, G3362, G3364, G3365, G3366, G3367, G3368, G3372, G3373, G3375, G3377, G3379, G3438, G3439, G3440, G3441, G3442, G3369, G3497, G3498, G3499, G3463, G3464, G3465, G3466, G3467, G3468, G3469 |
| 718 | G3376 | PRT | *Oryza sativa* | Paralogous to G3370, G3371, G3374, G3378; orthologous to G40, G2107, G2513, G41, G42, G912, G3362, G3364, G3365, G3366, G3367, G3368, G3372, G3373, G3375, G3377, G3379, G3438, G3439, G3440, G3441, G3442, G3369, G3497, G3498, G3499, G3463, G3464, G3465, G3466, G3467, G3468, G3469 |
| 719 | G3377 | DNA | *Oryza sativa* | Predicted polypeptide sequence is paralogous to G3372, G3373, G3375, G3379; orthologous to G40, G2107, G2513, G41, G42, G912, G3362, G3364, G3365, G3366, G3367, G3368, G3370, G3371, G3374, G3376, G3378, G3438, G3439, G3440, G3441, G3442, G3369, G3497, G3498, G3499, G3463, G3464, G3465, G3466, G3467, G3468, G3469 |
| 720 | G3377 | PRT | *Oryza sativa* | Paralogous to G3372, G3373, G3375, G3379; orthologous to G40, G2107, G2513, G41, G42, G912, G3362, G3364, G3365, G3366, G3367, G3368, G3370, G3371, G3374, G3376, G3378, G3438, G3439, G3440, G3441, G3442, G3369, G3497, G3498, G3499, G3463, G3464, G3465, G3466, G3467, G3468, G3469 |
| 721 | G3378 | DNA | *Oryza sativa* | Predicted polypeptide sequence is paralogous to G3370, G3371, G3374, G3376; orthologous to G40, G2107, G2513, G41, G42, G912, G3362, G3364, G3365, G3366, G3367, G3368, G3372, G3373, G3375, G3377, G3379, G3438, G3439, G3440, G3441, G3442, G3369, G3497, G3498, G3499, G3463, G3464, G3465, G3466, G3467, G3468, G3469 |
| 722 | G3378 | PRT | *Oryza sativa* | Paralogous to G3370, G3371, G3374, G3376; orthologous to G40, G2107, G2513, G41, G42, G912, G3362, G3364, G3365, G3366, G3367, G3368, G3372, G3373, G3375, G3377, G3379, G3438, G3439, G3440, G3441, G3442, G3369, G3497, G3498, G3499, G3463, |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| | | | | G3464, G3465, G3466, G3467, G3468, G3469 |
| 723 | G3379 | DNA | *Oryza sativa* | Predicted polypeptide sequence is paralogous to G3372, G3373, G3375, G3377; orthologous to G40, G2107, G2513, G41, G42, G912, G3362, G3364, G3365, G3366, G3367, G3368, G3370, G3371, G3374, G3376, G3378, G3438, G3439, G3440, G3441, G3442, G3369, G3497, G3498, G3499, G3463, G3464, G3465, G3466, G3467, G3468, G3469 |
| 724 | G3379 | PRT | *Oryza sativa* | Paralogous to G3372, G3373, G3375, G3377; orthologous to G40, G2107, G2513, G41, G42, G912, G3362, G3364, G3365, G3366, G3367, G3368, G3370, G3371, G3374, G3376, G3378, G3438, G3439, G3440, G3441, G3442, G3369, G3497, G3498, G3499, G3463, G3464, G3465, G3466, G3467, G3468, G3469 |
| 725 | G3384 | DNA | *Oryza sativa* | Predicted polypeptide sequence is paralogous to G3385, G3386, G3502; orthologous to G256, G666, G668, G932, G3500, G3501, G3537, G3538, G3539, G3540, G3541 |
| 726 | G3384 | PRT | *Oryza sativa* | Paralogous to G3385, G3386, G3502; orthologous to G256, G666, G668, G932, G3500, G3501, G3537, G3538, G3539, G3540, G3541 |
| 727 | G3385 | DNA | *Oryza sativa* | Predicted polypeptide sequence is paralogous to G3384, G3386, G3502; orthologous to G256, G666, G668, G932, G3500, G3501, G3537, G3538, G3539, G3540, G3541 |
| 728 | G3385 | PRT | *Oryza sativa* | Paralogous to G3384, G3386, G3502; orthologous to G256, G666, G668, G932, G3500, G3501, G3537, G3538, G3539, G3540, G3541 |
| 729 | G3386 | DNA | *Oryza sativa* | Predicted polypeptide sequence is paralogous to G3384, G3385, G3502; orthologous to G256, G666, G668, G932, G3500, G3501, G3537, G3538, G3539, G3540, G3541 |
| 730 | G3386 | PRT | *Oryza sativa* | Paralogous to G3384, G3385, G3502; orthologous to G256, G666, G668, G932, G3500, G3501, G3537, G3538, G3539, G3540, G3541 |
| 731 | G3388 | DNA | *Oryza sativa* | Predicted polypeptide sequence is paralogous to G3389, G3390, G3391; orthologous to G1930, G867, G9, G993, G3432, G3433, G3451, G3452, G3453, G3454 |
| 732 | G3388 | PRT | *Oryza sativa* | Paralogous to G3389, G3390, G3391; orthologous to G1930, G867, G9, G993, G3432, G3433, G3451, G3452, G3453, G3454 |
| 733 | G3389 | DNA | *Oryza sativa* | Predicted polypeptide sequence is paralogous to G3388, G3390, G3391; orthologous to G1930, G867, G9, G993, G3432, G3433, G3451, G3452, G3453, G3454 |
| 734 | G3389 | PRT | *Oryza sativa* | Paralogous to G3388, G3390, G3391; orthologous to G1930, G867, G9, G993, G3432, G3433, G3451, G3452, G3453, G3454 |
| 735 | G3390 | DNA | *Oryza sativa* | Predicted polypeptide sequence is paralogous to G3388, G3389, G3391; orthologous to G1930, G867, G9, |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| | | | | G993, G3432, G3433, G3451, G3452, G3453, G3454 |
| 736 | G3390 | PRT | *Oryza sativa* | Paralogous to G3388, G3389, G3391; orthologous to G1930, G867, G9, G993, G3432, G3433, G3451, G3452, G3453, G3454 |
| 737 | G3391 | DNA | *Oryza sativa* | Predicted polypeptide sequence is paralogous to G3388, G3389, G3390; orthologous to G1930, G867, G9, G993, G3432, G3433, G3451, G3452, G3453, G3454 |
| 738 | G3391 | PRT | *Oryza sativa* | Paralogous to G3388, G3389, G3390; orthologous to G1930, G867, G9, G993, G3432, G3433, G3451, G3452, G3453, G3454 |
| 739 | G3432 | DNA | *Zea mays* | Predicted polypeptide sequence is paralogous to G3433; orthologous to G1930, G867, G9, G993, G3388, G3389, G3390, G3391, G3451, G3452, G3453, G3454 |
| 740 | G3432 | PRT | *Zea mays* | Paralogous to G3433; orthologous to G1930, G867, G9, G993, G3388, G3389, G3390, G3391, G3451, G3452, G3453, G3454 |
| 741 | G3433 | DNA | *Zea mays* | Predicted polypeptide sequence is paralogous to G3432; orthologous to G1930, G867, G9, G993, G3388, G3389, G3390, G3391, G3451, G3452, G3453, G3454 |
| 742 | G3433 | PRT | *Zea mays* | Paralogous to G3432; orthologous to G1930, G867, G9, G993, G3388, G3389, G3390, G3391, G3451, G3452, G3453, G3454 |
| 743 | G3438 | DNA | *Zea mays* | Predicted polypeptide sequence is paralogous to G3439, G3440, G3441, G3442; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3369, G3497, G3498, G3499, G3463, G3464, G3465, G3466, G3467, G3468, G3469 |
| 744 | G3438 | PRT | *Zea mays* | Paralogous to G3439, G3440, G3441, G3442; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3369, G3497, G3498, G3499, G3463, G3464, G3465, G3466, G3467, G3468, G3469 |
| 745 | G3439 | DNA | *Zea mays* | Predicted polypeptide sequence is paralogous to G3438, G3440, G3441, G3442; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3369, G3497, G3498, G3499, G3463, G3464, G3465, G3466, G3467, G3468, G3469 |
| 746 | G3439 | PRT | *Zea mays* | Paralogous to G3438, G3440, G3441, G3442; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3369, |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| | | | | G3497, G3498, G3499, G3463, G3464, G3465, G3466, G3467, G3468, G3469 |
| 747 | G3440 | DNA | Zea mays | Predicted polypeptide sequence is paralogous to G3438, G3439, G3441, G3442; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3369, G3497, G3498, G3499, G3463, G3464, G3465, G3466, G3467, G3468, G3469 |
| 748 | G3440 | PRT | Zea mays | Paralogous to G3438, G3439, G3441, G3442; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3369, G3497, G3498, G3499, G3463, G3464, G3465, G3466, G3467, G3468, G3469 |
| 749 | G3441 | DNA | Zea mays | Predicted polypeptide sequence is paralogous to G3438, G3439, G3440, G3442; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3369, G3497, G3498, G3499, G3463, G3464, G3465, G3466, G3467, G3468, G3469 |
| 750 | G3441 | PRT | Zea mays | Paralogous to G3438, G3439, G3440, G3442; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3369, G3497, G3498, G3499, G3463, G3464, G3465, G3466, G3467, G3468, G3469 |
| 751 | G3442 | DNA | Zea mays | Predicted polypeptide sequence is paralogous to G3438, G3439, G3440, G3441; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3369, G3497, G3498, G3499, G3463, G3464, G3465, G3466, G3467, G3468, G3469 |
| 752 | G3442 | PRT | Zea mays | Paralogous to G3438, G3439, G3440, G3441; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3369, G3497, G3498, G3499, G3463, G3464, G3465, G3466, G3467, G3468, G3469 |
| 753 | G3451 | DNA | Glycine max | Predicted polypeptide sequence is paralogous to G3452, G3453, G3454; orthologous to G1930, G867, G9, G993, G3388, G3389, G3390, G3391, G3432, G3433 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| 754 | G3451 | PRT | *Glycine max* | Paralogous to G3452, G3453, G3454; orthologous to G1930, G867, G9, G993, G3388, G3389, G3390, G3391, G3432, G3433 |
| 755 | G3452 | DNA | *Glycine max* | Predicted polypeptide sequence is paralogous to G3451, G3453, G3454; orthologous to G1930, G867, G9, G993, G3388, G3389, G3390, G3391, G3432, G3433 |
| 756 | G3452 | PRT | *Glycine max* | Paralogous to G3451, G3453, G3454; orthologous to G1930, G867, G9, G993, G3388, G3389, G3390, G3391, G3432, G3433 |
| 757 | G3453 | DNA | *Glycine max* | Predicted polypeptide sequence is paralogous to G3451, G3452, G3454; orthologous to G1930, G867, G9, G993, G3388, G3389, G3390, G3391, G3432, G3433 |
| 758 | G3453 | PRT | *Glycine max* | Paralogous to G3451, G3452, G3454; orthologous to G1930, G867, G9, G993, G3388, G3389, G3390, G3391, G3432, G3433 |
| 759 | G3454 | DNA | *Glycine max* | Predicted polypeptide sequence is paralogous to G3451, G3452, G3453; orthologous to G1930, G867, G9, G993, G3388, G3389, G3390, G3391, G3432, G3433 |
| 760 | G3454 | PRT | *Glycine max* | Paralogous to G3451, G3452, G3453; orthologous to G1930, G867, G9, G993, G3388, G3389, G3390, G3391, G3432, G3433 |
| 761 | G3463 | DNA | *Glycine max* | Predicted polypeptide sequence is paralogous to G3464, G3465, G3466, G3467, G3468, G3469; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499 |
| 762 | G3463 | PRT | *Glycine max* | Paralogous to G3464, G3465, G3466, G3467, G3468, G3469; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499 |
| 763 | G3464 | DNA | *Glycine max* | Predicted polypeptide sequence is paralogous to G3463, G3465, G3466, G3467, G3468, G3469; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499 |
| 764 | G3464 | PRT | *Glycine max* | Paralogous to G3463, G3465, G3466, G3467, G3468, G3469; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| | | | | G3442, G3369, G3497, G3498, G3499 |
| 765 | G3465 | DNA | *Glycine max* | Predicted polypeptide sequence is paralogous to G3463, G3464, G3466, G3467, G3468, G3469; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499 |
| 766 | G3465 | PRT | *Glycine max* | Paralogous to G3463, G3464, G3466, G3467, G3468, G3469; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499 |
| 767 | G3466 | DNA | *Glycine max* | Predicted polypeptide sequence is paralogous to G3463, G3464, G3465, G3467, G3468, G3469; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499 |
| 768 | G3466 | PRT | *Glycine max* | Paralogous to G3463, G3464, G3465, G3467, G3468, G3469; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499 |
| 769 | G3467 | DNA | *Glycine max* | Predicted polypeptide sequence is paralogous to G3463, G3464, G3465, G3466, G3468, G3469; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499 |
| 770 | G3467 | PRT | *Glycine max* | Paralogous to G3463, G3464, G3465, G3466, G3468, G3469; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499 |
| 771 | G3468 | DNA | *Glycine max* | Predicted polypeptide sequence is paralogous to G3463, G3464, G3465, G3466, G3467, G3469; orthologous to G40, G2107, G2513, G41, G42, G912, G3362, G3364, G3365, G3366, G3367, G3368, G3370, G3371, G3372, G3373, G3374, G3375, |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| | | | | G3376, G3377, G3378, G3379, G3438, G3439, G3440, G3441, G3442, G3369, G3497, G3498, G3499 |
| 772 | G3468 | PRT | *Glycine max* | Paralogous to G3463, G3464, G3465, G3466, G3467, G3469; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499 |
| 773 | G3469 | DNA | *Glycine max* | Predicted polypeptide sequence is paralogous to G3463, G3464, G3465, G3466, G3467, G3468; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499 |
| 774 | G3469 | PRT | *Glycine max* | Paralogous to G3463, G3464, G3465, G3466, G3467, G3468; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3497, G3498, G3499 |
| 775 | G3497 | DNA | *Medicago sativa* | Predicted polypeptide sequence is paralogous to G3498, G3499; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3463, G3464, G3465, G3466, G3467, G3468, G3469 |
| 776 | G3497 | PRT | *Medicago sativa* | Paralogous to G3498, G3499; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3463, G3464, G3465, G3466, G3467, G3468, G3469 |
| 777 | G3498 | DNA | *Medicago sativa* | Predicted polypeptide sequence is paralogous to G3497, G3499; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3463, G3464, G3465, G3466, G3467, G3468, G3469 |
| 778 | G3498 | PRT | *Medicago sativa* | Paralogous to G3497, G3499; orthologous to G40, G2107, G2513, G41, G42, G912, G3362, G3364, G3365, G3366, G3367, G3368, G3370, G3371, G3372, G3373, |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| | | | | G3374, G3375, G3376, G3377, G3378, G3379, G3438, G3439, G3440, G3441, G3442, G3369, G3463, G3464, G3465, G3466, G3467, G3468, G3469 |
| 779 | G3499 | DNA | *Medicago sativa* | Predicted polypeptide sequence is paralogous to G3497, G3498; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3463, G3464, G3465, G3466, G3467, G3468, G3469 |
| 780 | G3499 | PRT | *Medicago sativa* | Paralogous to G3497, G3498; orthologous to G40, G2107, G2513, G41, G42, G912, G3362, G3364, G3365, G3366, G3367, G3368, G3370, G3371, G3372, G3373, G3374, G3375, G3376, G3377, G3378, G3379, G3438, G3439, G3440, G3441, G3442, G3369, G3463, G3464, G3465, G3466, G3467, G3468, G3469 |
| 781 | G3500 | DNA | *Lycopersicon esculentum* | Predicted polypeptide sequence is paralogous to G3501; orthologous to G256, G666, G668, G932, G3384, G3385, G3386, G3502, G3537, G3538, G3539, G3540, G3541 |
| 782 | G3500 | PRT | *Lycopersicon esculentum* | Paralogous to G3501; orthologous to G256, G666, G668, G932, G3384, G3385, G3386, G3502, G3537, G3538, G3539, G3540, G3541 |
| 783 | G3501 | DNA | *Lycopersicon esculentum* | Predicted polypeptide sequence is paralogous to G3500; orthologous to G256, G666, G668, G932, G3384, G3385, G3386, G3502, G3537, G3538, G3539, G3540, G3541 |
| 784 | G3501 | PRT | *Lycopersicon esculentum* | Paralogous to G3500; orthologous to G256, G666, G668, G932, G3384, G3385, G3386, G3502, G3537, G3538, G3539, G3540, G3541 |
| 785 | G3502 | DNA | *Oryza sativa* | Predicted polypeptide sequence is paralogous to G3384, G3385, G3386; orthologous to G256, G666, G668, G932, G3500, G3501, G3537, G3538, G3539, G3540, G3541 |
| 786 | G3502 | PRT | *Oryza sativa* | Paralogous to G3384, G3385, G3386; orthologous to G256, G666, G668, G932, G3500, G3501, G3537, G3538, G3539, G3540, G3541 |
| 787 | G3537 | DNA | *Glycine max* | Predicted polypeptide sequence is paralogous to G3538, G3539; orthologous to G256, G666, G668, G932, G3384, G3385, G3386, G3500, G3501, G3502, G3540, G3541 |
| 788 | G3537 | PRT | *Glycine max* | Paralogous to G3538, G3539; orthologous to G256, G666, G668, G932, G3384, G3385, G3386, G3500, G3501, G3502, G3540, G3541 |
| 789 | G3538 | DNA | *Glycine max* | Predicted polypeptide sequence is paralogous to G3537, G3539; orthologous to G256, G666, G668, G932, G3384, G3385, G3386, G3500, G3501, G3502, G3540, G3541 |
| 790 | G3538 | PRT | *Glycine max* | Paralogous to G3537, G3539; orthologous to G256, G666, G668, G932, G3384, G3385, G3386, G3500, G3501, G3502, G3540, G3541 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| 791 | G3539 | DNA | *Glycine max* | Predicted polypeptide sequence is paralogous to G3537, G3538; orthologous to G256, G666, G668, G932, G3384, G3385, G3386, G3500, G3501, G3502, G3540, G3541 |
| 792 | G3539 | PRT | *Glycine max* | Paralogous to G3537, G3538; orthologous to G256, G666, G668, G932, G3384, G3385, G3386, G3500, G3501, G3502, G3540, G3541 |
| 793 | G3540 | DNA | *Zea mays* | Predicted polypeptide sequence is paralogous to G3541; orthologous to G256, G666, G668, G932, G3384, G3385, G3386, G3500, G3501, G3502, G3537, G3538, G3539 |
| 794 | G3540 | PRT | *Zea mays* | Paralogous to G3541; orthologous to G256, G666, G668, G932, G3384, G3385, G3386, G3500, G3501, G3502, G3537, G3538, G3539 |
| 795 | G3541 | DNA | *Zea mays* | Predicted polypeptide sequence is paralogous to G3540; orthologous to G256, G666, G668, G932, G3384, G3385, G3386, G3500, G3501, G3502, G3537, G3538, G3539 |
| 796 | G3541 | PRT | *Zea mays* | Paralogous to G3540; orthologous to G256, G666, G668, G932, G3384, G3385, G3386, G3500, G3501, G3502, G3537, G3538, G3539 |
| 797 | G3652 | DNA | *Oryza sativa* | Predicted polypeptide sequence is paralogous to G3653, G3654, G3655; orthologous to G2576, G872 |
| 798 | G3652 | PRT | *Oryza sativa* | Paralogous to G3653, G3654, G3655; orthologous to G2576, G872 |
| 799 | G3653 | DNA | *Oryza sativa* | Predicted polypeptide sequence is paralogous to G3652, G3654, G3655; orthologous to G2576, G872 |
| 800 | G3653 | PRT | *Oryza sativa* | Paralogous to G3652, G3654, G3655; orthologous to G2576, G872 |
| 801 | G3654 | DNA | *Oryza sativa* | Predicted polypeptide sequence is paralogous to G3652, G3653, G3655; orthologous to G2576, G872 |
| 802 | G3654 | PRT | *Oryza sativa* | Paralogous to G3652, G3653, G3655; orthologous to G2576, G872 |
| 803 | G3655 | DNA | *Oryza sativa* | Predicted polypeptide sequence is paralogous to G3652, G3653, G3654; orthologous to G2576, G872 |
| 804 | G3655 | PRT | *Oryza sativa* | Paralogous to G3652, G3653, G3654; orthologous to G2576, G872 |
| 805 | G3656 | DNA | *Zea mays* | Predicted polypeptide sequence is orthologous to G12, G1277, G1379, G24 |
| 806 | G3656 | PRT | *Zea mays* | Orthologous to G12, G1277, G1379, G24 |
|  | Os_S32369 | DNA | *Oryza sativa* | Predicted polypeptide sequence is orthologous to G24 |
|  | Os_S80194 | DNA | *Oryza sativa* | Predicted polypeptide sequence is orthologous to G24 |
|  | Os_S60918 | DNA | *Oryza sativa* | Predicted polypeptide sequence is orthologous to G154 |
|  | Os_S112966 | DNA | *Oryza sativa* | Predicted polypeptide sequence is orthologous to G384 |
|  | Os_S113503 | DNA | *Oryza sativa* | Predicted polypeptide sequence is orthologous to G384 |
|  | Os_S96499 | DNA | *Oryza sativa* | Predicted polypeptide sequence is orthologous to G1868 |
|  | Os_S60490 | DNA | *Oryza sativa* | Predicted polypeptide sequence is orthologous to G1888 |
|  | Os_S60479 | DNA | *Oryza sativa* | Predicted polypeptide sequence is orthologous to G200 |
|  | Os_S100515 | DNA | *Oryza sativa* | Predicted polypeptide sequence is orthologous to G347 |
|  | Os_S60901 | DNA | *Oryza sativa* | Predicted polypeptide sequence is orthologous to G427 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
| --- | --- | --- | --- | --- |
| | Os_S64872 | DNA | *Oryza sativa* | Predicted polypeptide sequence is orthologous to G427 |
| | Os_S64899 | DNA | *Oryza sativa* | Predicted polypeptide sequence is orthologous to G427 |
| | Os_S64900 | DNA | *Oryza sativa* | Predicted polypeptide sequence is orthologous to G427 |
| | Os_S113396 | DNA | *Oryza sativa* | Predicted polypeptide sequence is orthologous to G618, G2057 |
| | Os_S113398 | DNA | *Oryza sativa* | Predicted polypeptide sequence is orthologous to G618, G2057 |
| | Os_S76089 | DNA | *Oryza sativa* | Predicted polypeptide sequence is orthologous to G653 |
| | Os_S44434 | DNA | *Oryza sativa* | Predicted polypeptide sequence is orthologous to G866 |
| | Os_S116938 | DNA | *Oryza sativa* | Predicted polypeptide sequence is orthologous to G912 |
| | Os_S116940 | DNA | *Oryza sativa* | Predicted polypeptide sequence is orthologous to G912 |
| | Os_S117813 | DNA | *Oryza sativa* | Predicted polypeptide sequence is orthologous to G912 |
| | Os_S65912 | DNA | *Oryza sativa* | Predicted polypeptide sequence is orthologous to G912 |
| | Os_S61189 | DNA | *Oryza sativa* | Predicted polypeptide sequence is orthologous to G958 |
| | Os_S69951 | DNA | *Oryza sativa* | Predicted polypeptide sequence is orthologous to G958 |
| | Os_S98061 | DNA | *Oryza sativa* | Predicted polypeptide sequence is orthologous to G1535 |
| | Os_S75175 | DNA | *Oryza sativa* | Predicted polypeptide sequence is orthologous to G1930 |
| | Gma_S5071803 | DNA | *Glycine max* | Predicted polypeptide sequence is orthologous to G24 |
| | Gma_S5094568 | DNA | *Glycine max* | Predicted polypeptide sequence is orthologous to G154 |
| | Gma_S4992142 | DNA | *Glycine max* | Predicted polypeptide sequence is orthologous to G384 |
| | Gma_S4873409 | DNA | *Glycine max* | Predicted polypeptide sequence is orthologous to G545 |
| | Gma_S5146663 | DNA | *Glycine max* | Predicted polypeptide sequence is orthologous to G545 |
| | Gma_S4883349 | DNA | *Glycine max* | Predicted polypeptide sequence is orthologous to G760 |
| | Gma_S5050636 | DNA | *Glycine max* | Predicted polypeptide sequence is orthologous to G773 |
| | Gma_S5129137 | DNA | *Glycine max* | Predicted polypeptide sequence is orthologous to G937 |
| | Gma_S4904682 | DNA | *Glycine max* | Predicted polypeptide sequence is orthologous to G1322 |
| | Gma_S5045510 | DNA | *Glycine max* | Predicted polypeptide sequence is orthologous to G2520 |
| | Gma_S4864518 | DNA | *Glycine max* | Predicted polypeptide sequence is orthologous to G2522 |
| | Gma_S4935598 | DNA | *Glycine max* | Predicted polypeptide sequence is orthologous to G2789 |
| | Gma_S4901804 | DNA | *Glycine max* | Predicted polypeptide sequence is orthologous to G189 |
| | Gma_S4898629 | DNA | *Glycine max* | Predicted polypeptide sequence is orthologous to G275, G837 |
| | Gma_S4907362 | DNA | *Glycine max* | Predicted polypeptide sequence is orthologous to G275, G837 |
| | Gma_S4934838 | DNA | *Glycine max* | Predicted polypeptide sequence is orthologous to G347 |
| | Gma_S4867945 | DNA | *Glycine max* | Predicted polypeptide sequence is orthologous to G427 |
| | Gma_S4863794 | DNA | *Glycine max* | Predicted polypeptide sequence is orthologous to G602 |
| | Gma_S5029115 | DNA | *Glycine max* | Predicted polypeptide sequence is orthologous to G618, G2057 |
| | Gma_S4874203 | DNA | *Glycine max* | Predicted polypeptide sequence is orthologous to G866 |
| | Gma_S4886425 | DNA | *Glycine max* | Predicted polypeptide sequence is orthologous to G866 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| | Gma_S5106568 | DNA | *Glycine max* | Predicted polypeptide sequence is orthologous to G866 |
| | Gma_S5001940 | DNA | *Glycine max* | Predicted polypeptide sequence is orthologous to G964 |
| | Gma_S5131758 | DNA | *Glycine max* | Predicted polypeptide sequence is orthologous to G1049 |
| | Gma_S4889036 | DNA | *Glycine max* | Predicted polypeptide sequence is orthologous to G1835 |
| | Gma_S4911179 | DNA | *Glycine max* | Predicted polypeptide sequence is orthologous to G1835 |
| | Gma_S5137324 | DNA | *Glycine max* | Predicted polypeptide sequence is orthologous to G2535 |
| | Mtr_S5349908 | DNA | *Medicago truncatula* | Predicted polypeptide sequence is orthologous to G24 |
| | Mtr_S5357829 | DNA | *Medicago truncatula* | Predicted polypeptide sequence is orthologous to G154 |
| | Mtr_S5447672 | DNA | *Medicago truncatula* | Predicted polypeptide sequence is orthologous to G384 |
| | Mtr_S5317695 | DNA | *Medicago truncatula* | Predicted polypeptide sequence is orthologous to G545 |
| | Mtr_S5431156 | DNA | *Medicago truncatula* | Predicted polypeptide sequence is orthologous to G545 |
| | Mtr_S5340844 | DNA | *Medicago truncatula* | Predicted polypeptide sequence is orthologous to G760 |
| | Mtr_S7090764 | DNA | *Medicago truncatula* | Predicted polypeptide sequence is orthologous to G760 |
| | Mtr_S10820905 | DNA | *Medicago truncatula* | Predicted polypeptide sequence is orthologous to G1888 |
| | Mtr_S10821012 | DNA | *Medicago truncatula* | Predicted polypeptide sequence is orthologous to G275, G837 |
| | Mtr_S5454462 | DNA | *Medicago truncatula* | Predicted polypeptide sequence is orthologous to G347 |
| | Mtr_S5306926 | DNA | *Medicago truncatula* | Predicted polypeptide sequence is orthologous to G427 |
| | Mtr_S5449876 | DNA | *Medicago truncatula* | Predicted polypeptide sequence is orthologous to G427 |
| | Mtr_S7092065 | DNA | *Medicago truncatula* | Predicted polypeptide sequence is orthologous to G427 |
| | Mtr_S5431439 | DNA | *Medicago truncatula* | Predicted polypeptide sequence is orthologous to G602 |
| | Mtr_S5399163 | DNA | *Medicago truncatula* | Predicted polypeptide sequence is orthologous to G635 |
| | Mtr_S7091176 | DNA | *Medicago truncatula* | Predicted polypeptide sequence is orthologous to G653 |
| | Mtr_S5305224 | DNA | *Medicago truncatula* | Predicted polypeptide sequence is orthologous to G866 |
| | Mtr_S7091692 | DNA | *Medicago truncatula* | Predicted polypeptide sequence is orthologous to G866 |
| | Mtr_S5409553 | DNA | *Medicago truncatula* | Predicted polypeptide sequence is orthologous to G1255 |
| | Mtr_S5430627 | DNA | *Medicago truncatula* | Predicted polypeptide sequence is orthologous to G1930 |
| | Hv_S30279 | DNA | *Hordeum vulgare* | Predicted polypeptide sequence is orthologous to G384 |
| | Hv_S36040 | DNA | *Hordeum vulgare* | Predicted polypeptide sequence is orthologous to G2522 |
| | Hv_S8292 | DNA | *Hordeum vulgare* | Predicted polypeptide sequence is orthologous to G275, G837 |
| | Hv_S67575 | DNA | *Hordeum vulgare* | Predicted polypeptide sequence is orthologous to G326 |
| | Hv_S23303 | DNA | *Hordeum vulgare* | Predicted polypeptide sequence is orthologous to G427 |
| | Hv_S136844 | DNA | *Hordeum vulgare* | Predicted polypeptide sequence is orthologous to G653 |
| | Hv_S152300 | DNA | *Hordeum vulgare* | Predicted polypeptide sequence is orthologous to G912 |
| | Hv_S158942 | DNA | *Hordeum vulgare* | Predicted polypeptide sequence is orthologous to G912 |
| | Hv_S74288 | DNA | *Hordeum vulgare* | Predicted polypeptide sequence is orthologous to G912 |
| | Hv_S74289 | DNA | *Hordeum vulgare* | Predicted polypeptide sequence is orthologous to G912 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| | Hv_S20601 | DNA | *Hordeum vulgare* | Predicted polypeptide sequence is orthologous to G2512 |
| | Zm_S11418746 | DNA | *Zea mays* | Predicted polypeptide sequence is orthologous to G154 |
| | Zm_S11527819 | DNA | *Zea mays* | Predicted polypeptide sequence is orthologous to G154 |
| | Zm_S11333633 | DNA | *Zea mays* | Predicted polypeptide sequence is orthologous to G384 |
| | Zm_S11401894 | DNA | *Zea mays* | Predicted polypeptide sequence is orthologous to G384 |
| | Zm_S11418286 | DNA | *Zea mays* | Predicted polypeptide sequence is orthologous to G384 |
| | Zm_S11418453 | DNA | *Zea mays* | Predicted polypeptide sequence is orthologous to G384 |
| | Zm_S11418455 | DNA | *Zea mays* | Predicted polypeptide sequence is orthologous to G384 |
| | Zm_S11523949 | DNA | *Zea mays* | Predicted polypeptide sequence is orthologous to G384 |
| | Zm_S11441492 | DNA | *Zea mays* | Predicted polypeptide sequence is orthologous to G545 |
| | Zm_S11443346 | DNA | *Zea mays* | Predicted polypeptide sequence is orthologous to G545 |
| | Zm_S11465527 | DNA | *Zea mays* | Predicted polypeptide sequence is orthologous to G545 |
| | Zm_S11526816 | DNA | *Zea mays* | Predicted polypeptide sequence is orthologous to G760 |
| | Zm_S11529038 | DNA | *Zea mays* | Predicted polypeptide sequence is orthologous to G760 |
| | Zm_S11529147 | DNA | *Zea mays* | Predicted polypeptide sequence is orthologous to G1322 |
| | Zm_S11522646 | DNA | *Zea mays* | Predicted polypeptide sequence is orthologous to G1868 |
| | Zm_S11522707 | DNA | *Zea mays* | Predicted polypeptide sequence is orthologous to G1868 |
| | Zm_S11525236 | DNA | *Zea mays* | Predicted polypeptide sequence is orthologous to G1868 |
| | Zm_S11432778 | DNA | *Zea mays* | Predicted polypeptide sequence is orthologous to G1888 |
| | Zm_S11528772 | DNA | *Zea mays* | Predicted polypeptide sequence is orthologous to G2131, G979 |
| | Zm_S11524369 | DNA | *Zea mays* | Predicted polypeptide sequence is orthologous to G2520 |
| | Zm_S11529138 | DNA | *Zea mays* | Predicted polypeptide sequence is orthologous to G200 |
| | Zm_S11529143 | DNA | *Zea mays* | Predicted polypeptide sequence is orthologous to G200 |
| | Zm_S11529165 | DNA | *Zea mays* | Predicted polypeptide sequence is orthologous to G200 |
| | Zm_S11529159 | DNA | *Zea mays* | Predicted polypeptide sequence is orthologous to G234 |
| | Zm_S11529194 | DNA | *Zea mays* | Predicted polypeptide sequence is orthologous to G234 |
| | Zm_S11528144 | DNA | *Zea mays* | Predicted polypeptide sequence is orthologous to G275, G837 |
| | Zm_S11450524 | DNA | *Zea mays* | Predicted polypeptide sequence is orthologous to G326 |
| | Zm_S11510508 | DNA | *Zea mays* | Predicted polypeptide sequence is orthologous to G326 |
| | Zm_S11437336 | DNA | *Zea mays* | Predicted polypeptide sequence is orthologous to G347 |
| | Zm_S11520104 | DNA | *Zea mays* | Predicted polypeptide sequence is orthologous to G347 |
| | Zm_S11442066 | DNA | *Zea mays* | Predicted polypeptide sequence is orthologous to G427 |
| | Zm_S11452342 | DNA | *Zea mays* | Predicted polypeptide sequence is orthologous to G427 |
| | Zm_S11527509 | DNA | *Zea mays* | Predicted polypeptide sequence is orthologous to G427 |
| | Zm_S11527752 | DNA | *Zea mays* | Predicted polypeptide sequence is orthologous to G602 |
| | Zm_S11528938 | DNA | *Zea mays* | Predicted polypeptide sequence is orthologous to G653 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| | Zm_S11523935 | DNA | Zea mays | Predicted polypeptide sequence is orthologous to G866 |
| | Zm_S11519368 | DNA | Zea mays | Predicted polypeptide sequence is orthologous to G912 |
| | Zm_S11524655 | DNA | Zea mays | Predicted polypeptide sequence is orthologous to G932 |
| | Zm_S11529150 | DNA | Zea mays | Predicted polypeptide sequence is orthologous to G932 |
| | Zm_S11529161 | DNA | Zea mays | Predicted polypeptide sequence is orthologous to G932 |
| | Zm_S11529174 | DNA | Zea mays | Predicted polypeptide sequence is orthologous to G932 |
| | Zm_S11529193 | DNA | Zea mays | Predicted polypeptide sequence is orthologous to G932 |
| | Zm_S11437468 | DNA | Zea mays | Predicted polypeptide sequence is orthologous to G958 |
| | Zm_S11445843 | DNA | Zea mays | Predicted polypeptide sequence is orthologous to G1049 |
| | Zm_S11485770 | DNA | Zea mays | Predicted polypeptide sequence is orthologous to G1255 |
| | Zm_S11529198 | DNA | Zea mays | Predicted polypeptide sequence is orthologous to G1331 |
| | Zm_S11418454 | DNA | Zea mays | Predicted polypeptide sequence is orthologous to G1535 |
| | Zm_S11522858 | DNA | Zea mays | Predicted polypeptide sequence is orthologous to G1535 |
| | Zm_S11506592 | DNA | Zea mays | Predicted polypeptide sequence is orthologous to G1930 |
| | Ta_S203038 | DNA | Triticum aestivum | Predicted polypeptide sequence is orthologous to G154 |
| | Ta_S424724 | DNA | Triticum aestivum | Predicted polypeptide sequence is orthologous to G154 |
| | Ta_S133393 | DNA | Triticum aestivum | Predicted polypeptide sequence is orthologous to G384 |
| | Ta_S147812 | DNA | Triticum aestivum | Predicted polypeptide sequence is orthologous to G545 |
| | Ta_S66284 | DNA | Triticum aestivum | Predicted polypeptide sequence is orthologous to G545 |
| | Ta_S202572 | DNA | Triticum aestivum | Predicted polypeptide sequence is orthologous to G760 |
| | Ta_S178842 | DNA | Triticum aestivum | Predicted polypeptide sequence is orthologous to G1868 |
| | Ta_S84222 | DNA | Triticum aestivum | Predicted polypeptide sequence is orthologous to G2520 |
| | Ta_S115031 | DNA | Triticum aestivum | Predicted polypeptide sequence is orthologous to G2522 |
| | Ta_S65435 | DNA | Triticum aestivum | Predicted polypeptide sequence is orthologous to G2522 |
| | Ta_S177690 | DNA | Triticum aestivum | Predicted polypeptide sequence is orthologous to G8 |
| | Ta_S148486 | DNA | Triticum aestivum | Predicted polypeptide sequence is orthologous to G326 |
| | Ta_S64707 | DNA | Triticum aestivum | Predicted polypeptide sequence is orthologous to G347 |
| | Ta_S16327 | DNA | Triticum aestivum | Predicted polypeptide sequence is orthologous to G427 |
| | Ta_S201090 | DNA | Triticum aestivum | Predicted polypeptide sequence is orthologous to G427 |
| | Ta_S2764 | DNA | Triticum aestivum | Predicted polypeptide sequence is orthologous to G635 |
| | Ta_S166473 | DNA | Triticum aestivum | Predicted polypeptide sequence is orthologous to G653 |
| | Ta_S174179 | DNA | Triticum aestivum | Predicted polypeptide sequence is orthologous to G866 |
| | Ta_S280279 | DNA | Triticum aestivum | Predicted polypeptide sequence is orthologous to G866 |
| | Ta_S47586 | DNA | Triticum aestivum | Predicted polypeptide sequence is orthologous to G912 |
| | Ta_S75229 | DNA | Triticum aestivum | Predicted polypeptide sequence is orthologous to G912 |
| | Ta_S203158 | DNA | Triticum aestivum | Predicted polypeptide sequence is orthologous to G1255 |

TABLE 9-continued

Homologs and Other Related Genes of Representative *Arabidopsis* Transcription
Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| | Ta_S363550 | DNA | *Triticum aestivum* | Predicted polypeptide sequence is orthologous to G1255 |
| | Ta_S142289 | DNA | *Triticum aestivum* | Predicted polypeptide sequence is orthologous to G1835 |
| | Ta_S266353 | DNA | *Triticum aestivum* | Predicted polypeptide sequence is orthologous to G1835 |
| | Ta_S174040 | DNA | *Triticum aestivum* | Predicted polypeptide sequence is orthologous to G2145 |
| | Les_S5295933 | DNA | *Lycopersicon esculentum* | Predicted polypeptide sequence is orthologous to G154 |
| | Les_S5295623 | DNA | *Lycopersicon esculentum* | Predicted polypeptide sequence is orthologous to G773 |
| | Les_S5295726 | DNA | *Lycopersicon esculentum* | Predicted polypeptide sequence is orthologous to G988 |
| | Les_S5183164 | DNA | *Lycopersicon esculentum* | Predicted polypeptide sequence is orthologous to G2520 |
| | Les_S5203454 | DNA | *Lycopersicon esculentum* | Predicted polypeptide sequence is orthologous to G2520 |
| | Les_S6657758 | DNA | *Lycopersicon esculentum* | Predicted polypeptide sequence is orthologous to G189 |
| | Les_S5275585 | DNA | *Lycopersicon esculentum* | Predicted polypeptide sequence is orthologous to G347 |
| | Les_S5295728 | DNA | *Lycopersicon esculentum* | Predicted polypeptide sequence is orthologous to G427 |
| | Les_S5295749 | DNA | *Lycopersicon esculentum* | Predicted polypeptide sequence is orthologous to G427 |
| | Les_S5295478 | DNA | *Lycopersicon esculentum* | Predicted polypeptide sequence is orthologous to G618, G2057 |
| | Les_S6657761 | DNA | *Lycopersicon esculentum* | Predicted polypeptide sequence is orthologous to G866 |
| | Les_S6657762 | DNA | *Lycopersicon esculentum* | Predicted polypeptide sequence is orthologous to G866 |
| | Les_S5295301 | DNA | *Lycopersicon esculentum* | Predicted polypeptide sequence is orthologous to G912 |
| | Les_S5295595 | DNA | *Lycopersicon esculentum* | Predicted polypeptide sequence is orthologous to G932 |
| | Les_S5269007 | DNA | *Lycopersicon esculentum* | Predicted polypeptide sequence is orthologous to G1266 |
| | Les_S5295266 | DNA | *Lycopersicon esculentum* | Predicted polypeptide sequence is orthologous to G1266 |
| | Les_S5295755 | DNA | *Lycopersicon esculentum* | Predicted polypeptide sequence is orthologous to G1266 |
| | Les_S6682822 | DNA | *Lycopersicon esculentum* | Predicted polypeptide sequence is orthologous to G1266 |
| | Les_S5295754 | DNA | *Lycopersicon esculentum* | Predicted polypeptide sequence is orthologous to G1750 |
| | SGN-UNIGENE-49683 | DNA | *Lycopersicon esculentum* | Predicted polypeptide sequence is orthologous to G24 |
| | SGN-UNIGENE-54594 | DNA | *Lycopersicon esculentum* | Predicted polypeptide sequence is orthologous to G24 |
| | SGN-UNIGENE-SINGLET-47313 | DNA | *Lycopersicon esculentum* | Predicted polypeptide sequence is orthologous to G24 |
| | SGN-UNIGENE-50586 | DNA | *Lycopersicon esculentum* | Predicted polypeptide sequence is orthologous to G154 |
| | SGN-UNIGENE-52410 | DNA | *Lycopersicon esculentum* | Predicted polypeptide sequence is orthologous to G154 |
| | SGN-UNIGENE-SINGLET-366830 | DNA | *Lycopersicon esculentum* | Predicted polypeptide sequence is orthologous to G154 |
| | SGN-UNIGENE-SINGLET-394847 | DNA | *Lycopersicon esculentum* | Predicted polypeptide sequence is orthologous to G154 |
| | SGN-UNIGENE-SINGLET-17776 | DNA | *Lycopersicon esculentum* | Predicted polypeptide sequence is orthologous to G384 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| | SGN-UNIGENE-44163 | DNA | *Lycopersicon esculentum* | Predicted polypeptide sequence is orthologous to G545 |
| | SGN-UNIGENE-44287 | DNA | *Lycopersicon esculentum* | Predicted polypeptide sequence is orthologous to G545 |
| | SGN-UNIGENE-SINGLET-6983 | DNA | *Lycopersicon esculentum* | Predicted polypeptide sequence is orthologous to G545 |
| | SGN-UNIGENE-47781 | DNA | *Lycopersicon esculentum* | Predicted polypeptide sequence is orthologous to G760 |
| | SGN-UNIGENE-52634 | DNA | *Lycopersicon esculentum* | Predicted polypeptide sequence is orthologous to G760 |
| | SGN-UNIGENE-53754 | DNA | *Lycopersicon esculentum* | Predicted polypeptide sequence is orthologous to G760 |
| | SGN-UNIGENE-SINGLET-23750 | DNA | *Lycopersicon esculentum* | Predicted polypeptide sequence is orthologous to G760 |
| | SGN-UNIGENE-SINGLET-310313 | DNA | *Lycopersicon esculentum* | Predicted polypeptide sequence is orthologous to G760 |
| | SGN-UNIGENE-SINGLET-447414 | DNA | *Lycopersicon esculentum* | Predicted polypeptide sequence is orthologous to G760 |
| | SGN-UNIGENE-45948 | DNA | *Lycopersicon esculentum* | Predicted polypeptide sequence is orthologous to G773 |
| | SGN-UNIGENE-48215 | DNA | *Lycopersicon esculentum* | Predicted polypeptide sequence is orthologous to G773 |
| | SGN-UNIGENE-59076 | DNA | *Lycopersicon esculentum* | Predicted polypeptide sequence is orthologous to G1069 |
| | SGN-UNIGENE-54402 | DNA | *Lycopersicon esculentum* | Predicted polypeptide sequence is orthologous to G1090 |
| | SGN-UNIGENE-58620 | DNA | *Lycopersicon esculentum* | Predicted polypeptide sequence is orthologous to G1322 |
| | SGN-UNIGENE-SINGLET-16950 | DNA | *Lycopersicon esculentum* | Predicted polypeptide sequence is orthologous to G1322 |
| | SGN-UNIGENE-48848 | DNA | *Lycopersicon esculentum* | Predicted polypeptide sequence is orthologous to G1868 |
| | SGN-UNIGENE-SINGLET-453383 | DNA | *Lycopersicon esculentum* | Predicted polypeptide sequence is orthologous to G1868 |
| | SGN-UNIGENE-47593 | DNA | *Lycopersicon esculentum* | Predicted polypeptide sequence is orthologous to G1888 |
| | SGN-UNIGENE-SINGLET-517 | DNA | *Lycopersicon esculentum* | Predicted polypeptide sequence is orthologous to G2131, G979 |
| | SGN-UNIGENE-44928 | DNA | *Lycopersicon esculentum* | Predicted polypeptide sequence is orthologous to G2520 |
| | SGN-UNIGENE-50326 | DNA | *Lycopersicon esculentum* | Predicted polypeptide sequence is orthologous to G2522 |
| | SGN-UNIGENE-SINGLET-395477 | DNA | *Lycopersicon esculentum* | Predicted polypeptide sequence is orthologous to G8 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| | SGN-UNIGENE-54690 | DNA | *Lycopersicon esculentum* | Predicted polypeptide sequence is orthologous to G156 |
| | SGN-UNIGENE-57990 | DNA | *Lycopersicon esculentum* | Predicted polypeptide sequence is orthologous to G161 |
| | SGN-UNIGENE-57276 | DNA | *Lycopersicon esculentum* | Predicted polypeptide sequence is orthologous to G200 |
| | SGN-UNIGENE-SINGLET-385670 | DNA | *Lycopersicon esculentum* | Predicted polypeptide sequence is orthologous to G200 |
| | SGN-UNIGENE-SINGLET-21166 | DNA | *Lycopersicon esculentum* | Predicted polypeptide sequence is orthologous to G234 |
| | SGN-UNIGENE-47489 | DNA | *Lycopersicon esculentum* | Predicted polypeptide sequence is orthologous to G275, G837 |
| | SGN-UNIGENE-47510 | DNA | *Lycopersicon esculentum* | Predicted polypeptide sequence is orthologous to G275, G837 |
| | SGN-UNIGENE-51256 | DNA | *Lycopersicon esculentum* | Predicted polypeptide sequence is orthologous to G275, G837 |
| | SGN-UNIGENE-56050 | DNA | *Lycopersicon esculentum* | Predicted polypeptide sequence is orthologous to G275, G837 |
| | SGN-UNIGENE-SINGLET-19083 | DNA | *Lycopersicon esculentum* | Predicted polypeptide sequence is orthologous to G326 |
| | SGN-UNIGENE-51747 | DNA | *Lycopersicon esculentum* | Predicted polypeptide sequence is orthologous to G347 |
| | SGN-UNIGENE-51523 | DNA | *Lycopersicon esculentum* | Predicted polypeptide sequence is orthologous to G427 |
| | SGN-UNIGENE-54900 | DNA | *Lycopersicon esculentum* | Predicted polypeptide sequence is orthologous to G427 |
| | SGN-UNIGENE-55550 | DNA | *Lycopersicon esculentum* | Predicted polypeptide sequence is orthologous to G427 |
| | SGN-UNIGENE-55551 | DNA | *Lycopersicon esculentum* | Predicted polypeptide sequence is orthologous to G427 |
| | SGN-UNIGENE-SINGLET-397654 | DNA | *Lycopersicon esculentum* | Predicted polypeptide sequence is orthologous to G427 |
| | SGN-UNIGENE-SINGLET-446384 | DNA | *Lycopersicon esculentum* | Predicted polypeptide sequence is orthologous to G427 |
| | SGN-UNIGENE-SINGLET-50339 | DNA | *Lycopersicon esculentum* | Predicted polypeptide sequence is orthologous to G427 |
| | SGN-UNIGENE-SINGLET-9520 | DNA | *Lycopersicon esculentum* | Predicted polypeptide sequence is orthologous to G427 |
| | SGN-UNIGENE-47483 | DNA | *Lycopersicon esculentum* | Predicted polypeptide sequence is orthologous to G590 |
| | SGN-UNIGENE-47925 | DNA | *Lycopersicon esculentum* | Predicted polypeptide sequence is orthologous to G590 |
| | SGN-UNIGENE-SINGLET-2565 | DNA | *Lycopersicon esculentum* | Predicted polypeptide sequence is orthologous to G602 |
| | SGN-UNIGENE-50577 | DNA | *Lycopersicon esculentum* | Predicted polypeptide sequence is orthologous to G618, G2057 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| | SGN-UNIGENE-58580 | DNA | *Lycopersicon esculentum* | Predicted polypeptide sequence is orthologous to G618, G2057 |
| | SGN-UNIGENE-SINGLET-24189 | DNA | *Lycopersicon esculentum* | Predicted polypeptide sequence is orthologous to G618, G2057 |
| | SGN-UNIGENE-SINGLET-394109 | DNA | *Lycopersicon esculentum* | Predicted polypeptide sequence is orthologous to G618, G2057 |
| | SGN-UNIGENE-SINGLET-401522 | DNA | *Lycopersicon esculentum* | Predicted polypeptide sequence is orthologous to G618, G2057 |
| | SGN-UNIGENE-56459 | DNA | *Lycopersicon esculentum* | Predicted polypeptide sequence is orthologous to G643 |
| | SGN-UNIGENE-46400 | DNA | *Lycopersicon esculentum* | Predicted polypeptide sequence is orthologous to G653 |
| | SGN-UNIGENE-SINGLET-64524 | DNA | *Lycopersicon esculentum* | Predicted polypeptide sequence is orthologous to G653 |
| | SGN-UNIGENE-45903 | DNA | *Lycopersicon esculentum* | Predicted polypeptide sequence is orthologous to G866 |
| | SGN-UNIGENE-SINGLET-439904 | DNA | *Lycopersicon esculentum* | Predicted polypeptide sequence is orthologous to G866 |
| | SGN-UNIGENE-50296 | DNA | *Lycopersicon esculentum* | Predicted polypeptide sequence is orthologous to G872 |
| | SGN-UNIGENE-46974 | DNA | *Lycopersicon esculentum* | Predicted polypeptide sequence is orthologous to G912 |
| | SGN-UNIGENE-46975 | DNA | *Lycopersicon esculentum* | Predicted polypeptide sequence is orthologous to G912 |
| | SGN-UNIGENE-58571 | DNA | *Lycopersicon esculentum* | Predicted polypeptide sequence is orthologous to G912 |
| | SGN-UNIGENE-SINGLET-398604 | DNA | *Lycopersicon esculentum* | Predicted polypeptide sequence is orthologous to G912 |
| | SGN-UNIGENE-52504 | DNA | *Lycopersicon esculentum* | Predicted polypeptide sequence is orthologous to G932 |
| | SGN-UNIGENE-52540 | DNA | *Lycopersicon esculentum* | Predicted polypeptide sequence is orthologous to G932 |
| | SGN-UNIGENE-57232 | DNA | *Lycopersicon esculentum* | Predicted polypeptide sequence is orthologous to G932 |
| | SGN-UNIGENE-SINGLET-14957 | DNA | *Lycopersicon esculentum* | Predicted polypeptide sequence is orthologous to G975 |
| | SGN-UNIGENE-SINGLET-335836 | DNA | *Lycopersicon esculentum* | Predicted polypeptide sequence is orthologous to G975 |
| | SGN-UNIGENE-SINGLET-333614 | DNA | *Lycopersicon esculentum* | Predicted polypeptide sequence is orthologous to G1049 |
| | SGN-UNIGENE-48698 | DNA | *Lycopersicon esculentum* | Predicted polypeptide sequence is orthologous to G1255 |
| | SGN-UNIGENE-53476 | DNA | *Lycopersicon esculentum* | Predicted polypeptide sequence is orthologous to G1255 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| | SGN-UNIGENE-54828 | DNA | *Lycopersicon esculentum* | Predicted polypeptide sequence is orthologous to G1255 |
| | SGN-UNIGENE-48067 | DNA | *Lycopersicon esculentum* | Predicted polypeptide sequence is orthologous to G1266 |
| | SGN-UNIGENE-49923 | DNA | *Lycopersicon esculentum* | Predicted polypeptide sequence is orthologous to G1266 |
| | SGN-UNIGENE-52630 | DNA | *Lycopersicon esculentum* | Predicted polypeptide sequence is orthologous to G1266 |
| | SGN-UNIGENE-SINGLET-38956 | DNA | *Lycopersicon esculentum* | Predicted polypeptide sequence is orthologous to G1266 |
| | SGN-UNIGENE-SINGLET-13754 | DNA | *Lycopersicon esculentum* | Predicted polypeptide sequence is orthologous to G1535 |
| | SGN-UNIGENE-49801 | DNA | *Lycopersicon esculentum* | Predicted polypeptide sequence is orthologous to G1750 |
| | SGN-UNIGENE-SINGLET-2078 | DNA | *Lycopersicon esculentum* | Predicted polypeptide sequence is orthologous to G1750 |
| | SGN-UNIGENE-SINGLET-446513 | DNA | *Lycopersicon esculentum* | Predicted polypeptide sequence is orthologous to G1750 |
| | SGN-UNIGENE-48476 | DNA | *Lycopersicon esculentum* | Predicted polypeptide sequence is orthologous to G1835 |
| | SGN-UNIGENE-51325 | DNA | *Lycopersicon esculentum* | Predicted polypeptide sequence is orthologous to G1835 |
| | SGN-UNIGENE-47598 | DNA | *Lycopersicon esculentum* | Predicted polypeptide sequence is orthologous to G1930 |
| | SGN-UNIGENE-SINGLET-393621 | DNA | *Lycopersicon esculentum* | Predicted polypeptide sequence is orthologous to G1930 |
| | SGN-UNIGENE-SINGLET-44327 | DNA | *Lycopersicon esculentum* | Predicted polypeptide sequence is orthologous to G1930 |
| | SGN-UNIGENE-51335 | DNA | *Lycopersicon esculentum* | Predicted polypeptide sequence is orthologous to G2144 |
| | SGN-UNIGENE-SINGLET-2865 | DNA | *Lycopersicon esculentum* | Predicted polypeptide sequence is orthologous to G2512 |
| | SGN-UNIGENE-SINGLET-366637 | DNA | *Lycopersicon esculentum* | Predicted polypeptide sequence is orthologous to G2535 |
| | SGN-UNIGENE-SINGLET-357168 | DNA | *Lycopersicon esculentum* | Predicted polypeptide sequence is orthologous to G2719 |
| | Vvi_S15370190 | DNA | *Vitis vinifera* | Predicted polypeptide sequence is orthologous to G24 |
| | Vvi_S16806812 | DNA | *Vitis vinifera* | Predicted polypeptide sequence is orthologous to G24 |
| | Vvi_S15373999 | DNA | *Vitis vinifera* | Predicted polypeptide sequence is orthologous to G154 |
| | Vvi_S16872184 | DNA | *Vitis vinifera* | Predicted polypeptide sequence is orthologous to G154 |
| | Vvi_S15355617 | DNA | *Vitis vinifera* | Predicted polypeptide sequence is orthologous to G545 |
| | Vvi_S15382170 | DNA | *Vitis vinifera* | Predicted polypeptide sequence is orthologous to G545 |
| | Vvi_S16873427 | DNA | *Vitis vinifera* | Predicted polypeptide sequence is orthologous to G760 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| | Vvi_S15431951 | DNA | *Vitis vinifera* | Predicted polypeptide sequence is orthologous to G937 |
| | Vvi_S16805106 | DNA | *Vitis vinifera* | Predicted polypeptide sequence is orthologous to G937 |
| | Vvi_S16805621 | DNA | *Vitis vinifera* | Predicted polypeptide sequence is orthologous to G1069 |
| | Vvi_S15388842 | DNA | *Vitis vinifera* | Predicted polypeptide sequence is orthologous to G1322 |
| | Vvi_S15421316 | DNA | *Vitis vinifera* | Predicted polypeptide sequence is orthologous to G2520 |
| | Vvi_S16529182 | DNA | *Vitis vinifera* | Predicted polypeptide sequence is orthologous to G2520 |
| | Vvi_S15370801 | DNA | *Vitis vinifera* | Predicted polypeptide sequence is orthologous to G2522 |
| | Vvi_S15411435 | DNA | *Vitis vinifera* | Predicted polypeptide sequence is orthologous to G8 |
| | Vvi_S15353287 | DNA | *Vitis vinifera* | Predicted polypeptide sequence is orthologous to G189 |
| | Vvi_S15374453 | DNA | *Vitis vinifera* | Predicted polypeptide sequence is orthologous to G189 |
| | Vvi_S15426449 | DNA | *Vitis vinifera* | Predicted polypeptide sequence is orthologous to G275, G837 |
| | Vvi_S16870363 | DNA | *Vitis vinifera* | Predicted polypeptide sequence is orthologous to G275, G837 |
| | Vvi_S16531517 | DNA | *Vitis vinifera* | Predicted polypeptide sequence is orthologous to G347 |
| | Vvi_S15401282 | DNA | *Vitis vinifera* | Predicted polypeptide sequence is orthologous to G427 |
| | Vvi_S15423741 | DNA | *Vitis vinifera* | Predicted polypeptide sequence is orthologous to G427 |
| | Vvi_S15353882 | DNA | *Vitis vinifera* | Predicted polypeptide sequence is orthologous to G602 |
| | Vvi_S15426604 | DNA | *Vitis vinifera* | Predicted polypeptide sequence is orthologous to G653 |
| | Vvi_S15374416 | DNA | *Vitis vinifera* | Predicted polypeptide sequence is orthologous to G866 |
| | Vvi_S16870232 | DNA | *Vitis vinifera* | Predicted polypeptide sequence is orthologous to G872 |
| | Vvi_S15357313 | DNA | *Vitis vinifera* | Predicted polypeptide sequence is orthologous to G912 |
| | Vvi_S15391707 | DNA | *Vitis vinifera* | Predicted polypeptide sequence is orthologous to G912 |
| | Vvi_S16532074 | DNA | *Vitis vinifera* | Predicted polypeptide sequence is orthologous to G932 |
| | Vvi_S15427527 | DNA | *Vitis vinifera* | Predicted polypeptide sequence is orthologous to G1255 |
| | Vvi_S15431583 | DNA | *Vitis vinifera* | Predicted polypeptide sequence is orthologous to G1255 |
| | Vvi_S16871195 | DNA | *Vitis vinifera* | Predicted polypeptide sequence is orthologous to G1494 |
| | Vvi_S16865934 | DNA | *Vitis vinifera* | Predicted polypeptide sequence is orthologous to G1835 |
| | Vvi_S16529913 | DNA | *Vitis vinifera* | Predicted polypeptide sequence is orthologous to G2144 |
| | Pta_S15732813 | DNA | *Pinus taeda* | Predicted polypeptide sequence is orthologous to G154 |
| | Pta_S15736271 | DNA | *Pinus taeda* | Predicted polypeptide sequence is orthologous to G154 |
| | Pta_S15739572 | DNA | *Pinus taeda* | Predicted polypeptide sequence is orthologous to G154 |
| | Pta_S15740527 | DNA | *Pinus taeda* | Predicted polypeptide sequence is orthologous to G154 |
| | Pta_S15746398 | DNA | *Pinus taeda* | Predicted polypeptide sequence is orthologous to G154 |
| | Pta_S15751737 | DNA | *Pinus taeda* | Predicted polypeptide sequence is orthologous to G154 |
| | Pta_S15777399 | DNA | *Pinus taeda* | Predicted polypeptide sequence is orthologous to G154 |
| | Pta_S15780122 | DNA | *Pinus taeda* | Predicted polypeptide sequence is orthologous to G154 |
| | Pta_S15795745 | DNA | *Pinus taeda* | Predicted polypeptide sequence is orthologous to G154 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| | Pta_S16849782 | DNA | *Pinus taeda* | Predicted polypeptide sequence is orthologous to G154 |
| | Pta_S16789085 | DNA | *Pinus taeda* | Predicted polypeptide sequence is orthologous to G760 |
| | Pta_S17046663 | DNA | *Pinus taeda* | Predicted polypeptide sequence is orthologous to G1666 |
| | Pta_S16800293 | DNA | *Pinus taeda* | Predicted polypeptide sequence is orthologous to G1868 |
| | Pta_S15767209 | DNA | *Pinus taeda* | Predicted polypeptide sequence is orthologous to G2522 |
| | Pta_S15799222 | DNA | *Pinus taeda* | Predicted polypeptide sequence is orthologous to G2789 |
| | Pta_S16786360 | DNA | *Pinus taeda* | Predicted polypeptide sequence is orthologous to G2789 |
| | Pta_S16788492 | DNA | *Pinus taeda* | Predicted polypeptide sequence is orthologous to G2789 |
| | Pta_S16802054 | DNA | *Pinus taeda* | Predicted polypeptide sequence is orthologous to G2789 |
| | Pta_S16793418 | DNA | *Pinus taeda* | Predicted polypeptide sequence is orthologous to G189 |
| | Pta_S15736214 | DNA | *Pinus taeda* | Predicted polypeptide sequence is orthologous to G275, G837 |
| | Pta_S15776645 | DNA | *Pinus taeda* | Predicted polypeptide sequence is orthologous to G275, G837 |
| | Pta_S17049915 | DNA | *Pinus taeda* | Predicted polypeptide sequence is orthologous to G326 |
| | Pta_S16847381 | DNA | *Pinus taeda* | Predicted polypeptide sequence is orthologous to G427 |
| | Pta_S17051722 | DNA | *Pinus taeda* | Predicted polypeptide sequence is orthologous to G427 |
| | Pta_S16797626 | DNA | *Pinus taeda* | Predicted polypeptide sequence is orthologous to G602 |
| | Pta_S16790444 | DNA | *Pinus taeda* | Predicted polypeptide sequence is orthologous to G653 |
| | Pta_S17050802 | DNA | *Pinus taeda* | Predicted polypeptide sequence is orthologous to G653 |
| | Pta_S15754706 | DNA | *Pinus taeda* | Predicted polypeptide sequence is orthologous to G872 |
| | Pta_S15767728 | DNA | *Pinus taeda* | Predicted polypeptide sequence is orthologous to G872 |
| | Pta_S15779272 | DNA | *Pinus taeda* | Predicted polypeptide sequence is orthologous to G872 |
| | Pta_S15738910 | DNA | *Pinus taeda* | Predicted polypeptide sequence is orthologous to G958 |
| | Pta_S15774939 | DNA | *Pinus taeda* | Predicted polypeptide sequence is orthologous to G958 |
| | Pta_S15797996 | DNA | *Pinus taeda* | Predicted polypeptide sequence is orthologous to G964 |
| 807 | G1048 | DNA | *Arabidopsis thaliana* | |
| 808 | G1048 | PRT | *Arabidopsis thaliana* | |
| 809 | G1100 | DNA | *Arabidopsis thaliana* | |
| 810 | G1100 | PRT | *Arabidopsis thaliana* | |
| 811 | G1796 | DNA | *Arabidopsis thaliana* | |
| 812 | G1796 | PRT | *Arabidopsis thaliana* | |
| 813 | G1995 | DNA | *Arabidopsis thaliana* | Predicted polypeptide sequence is paralogous to G2826, G2838, G361, G362, G370 |
| 814 | G1995 | PRT | *Arabidopsis thaliana* | Paralogous to G2826, G2838, G361, G362, G370 |
| 815 | G2467 | DNA | *Arabidopsis thaliana* | Predicted polypeptide sequence is paralogous to G812 |
| 816 | G2467 | PRT | *Arabidopsis thaliana* | Paralogous to G812 |
| 817 | G2505 | DNA | *Arabidopsis thaliana* | Predicted polypeptide sequence is paralogous to G2635 |
| 818 | G2505 | PRT | *Arabidopsis thaliana* | Paralogous to G2635 |
| 819 | G2550 | DNA | *Arabidopsis thaliana* | Predicted polypeptide sequence is paralogous to G2546 |
| 820 | G2550 | PRT | *Arabidopsis thaliana* | Paralogous to G2546 |
| 821 | G2640 | DNA | *Arabidopsis thaliana* | Predicted polypeptide sequence is paralogous to G2639, G2642 |
| 822 | G2640 | PRT | *Arabidopsis thaliana* | Paralogous to G2639, G2642 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| 823 | G2686 | DNA | *Arabidopsis thaliana* | Predicted polypeptide sequence is paralogous to G2586, G2587 |
| 824 | G2686 | PRT | *Arabidopsis thaliana* | Paralogous to G2586, G2587 |
| 825 | G38 | DNA | *Arabidopsis thaliana* | Predicted polypeptide sequence is paralogous to G1141 |
| 826 | G38 | PRT | *Arabidopsis thaliana* | Paralogous to G1141 |
| 827 | G44 | DNA | *Arabidopsis thaliana* | |
| 828 | G44 | PRT | *Arabidopsis thaliana* | |
| 829 | G230 | DNA | *Arabidopsis thaliana* | Predicted polypeptide sequence is paralogous to G207, G227, G242 |
| 830 | G230 | PRT | *Arabidopsis thaliana* | Paralogous to G207, G227, G242 |
| 831 | G261 | DNA | *Arabidopsis thaliana* | Predicted polypeptide sequence is paralogous to G265 |
| 832 | G261 | PRT | *Arabidopsis thaliana* | Paralogous to G265 |
| 833 | G271 | DNA | *Arabidopsis thaliana* | |
| 834 | G271 | PRT | *Arabidopsis thaliana* | |
| 835 | G359 | DNA | *Arabidopsis thaliana* | |
| 836 | G359 | PRT | *Arabidopsis thaliana* | |
| 837 | G377 | DNA | *Arabidopsis thaliana* | |
| 838 | G377 | PRT | *Arabidopsis thaliana* | |
| 839 | G388 | DNA | *Arabidopsis thaliana* | |
| 840 | G388 | PRT | *Arabidopsis thaliana* | |
| 841 | G435 | DNA | *Arabidopsis thaliana* | |
| 842 | G435 | PRT | *Arabidopsis thaliana* | |
| 843 | G442 | DNA | *Arabidopsis thaliana* | |
| 844 | G442 | PRT | *Arabidopsis thaliana* | |
| 845 | G468 | DNA | *Arabidopsis thaliana* | Predicted polypeptide sequence is paralogous to G2866 |
| 846 | G468 | PRT | *Arabidopsis thaliana* | Paralogous to G2866 |
| 847 | G571 | DNA | *Arabidopsis thaliana* | |
| 848 | G571 | PRT | *Arabidopsis thaliana* | |
| 849 | G652 | DNA | *Arabidopsis thaliana* | Predicted polypeptide sequence is paralogous to G1335 |
| 850 | G652 | PRT | *Arabidopsis thaliana* | Paralogous to G1335 |
| 851 | G664 | DNA | *Arabidopsis thaliana* | Predicted polypeptide sequence is paralogous to G197, G255; orthologous to G3503, G3504, G3505, G3506, G3507, G3508, G3509, G3529, G3531, G3532, G3533, G3534, G3527, G3528 |
| 852 | G664 | PRT | *Arabidopsis thaliana* | Paralogous to G197, G255; Orthologous to G3503, G3504, G3505, G3506, G3507, G3508, G3509, G3529, G3531, G3532, G3533, G3534, G3527, G3528 |
| 853 | G772 | DNA | *Arabidopsis thaliana* | Predicted polypeptide sequence is paralogous to G776 |
| 854 | G772 | PRT | *Arabidopsis thaliana* | Paralogous to G776 |
| 855 | G798 | DNA | *Arabidopsis thaliana* | Predicted polypeptide sequence is paralogous to G1897 |
| 856 | G798 | PRT | *Arabidopsis thaliana* | Paralogous to G1897 |
| 857 | G818 | DNA | *Arabidopsis thaliana* | |
| 858 | G818 | PRT | *Arabidopsis thaliana* | |
| 859 | G974 | DNA | *Arabidopsis thaliana* | Predicted polypeptide sequence is paralogous to G5 |
| 860 | G974 | PRT | *Arabidopsis thaliana* | Paralogous to G5 |
| 861 | G1062 | DNA | *Arabidopsis thaliana* | Predicted polypeptide sequence is paralogous to G1664 |
| 862 | G1062 | PRT | *Arabidopsis thaliana* | Paralogous to G1664 |
| 863 | G1129 | DNA | *Arabidopsis thaliana* | |
| 864 | G1129 | PRT | *Arabidopsis thaliana* | |
| 865 | G1137 | DNA | *Arabidopsis thaliana* | Predicted polypeptide sequence is paralogous to G1133 |
| 866 | G1137 | PRT | *Arabidopsis thaliana* | Paralogous to G1133 |
| 867 | G1425 | DNA | *Arabidopsis thaliana* | Predicted polypeptide sequence is paralogous to G1454, G504; orthologous to G3809 |
| 868 | G1425 | PRT | *Arabidopsis thaliana* | Paralogous to G1454, G504; Orthologous to G3809 |
| 869 | G1517 | DNA | *Arabidopsis thaliana* | |
| 870 | G1517 | PRT | *Arabidopsis thaliana* | |
| 871 | G1655 | DNA | *Arabidopsis thaliana* | |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| 872 | G1655 | PRT | *Arabidopsis thaliana* | |
| 873 | G1743 | DNA | *Arabidopsis thaliana* | |
| 874 | G1743 | PRT | *Arabidopsis thaliana* | |
| 875 | G1789 | DNA | *Arabidopsis thaliana* | Predicted polypeptide sequence is paralogous to G1911, G2721, G997 |
| 876 | G1789 | PRT | *Arabidopsis thaliana* | Paralogous to G1911, G2721, G997 |
| 877 | G1806 | DNA | *Arabidopsis thaliana* | Predicted polypeptide sequence is paralogous to G1198, G554, G555, G556, G558, G578, G629 |
| 878 | G1806 | PRT | *Arabidopsis thaliana* | Paralogous to G1198, G554, G555, G556, G558, G578, G629 |
| 879 | G1911 | DNA | *Arabidopsis thaliana* | Predicted polypeptide sequence is paralogous to G1789, G2721, G997 |
| 880 | G1911 | PRT | *Arabidopsis thaliana* | Paralogous to G1789, G2721, G997 |
| 881 | G2011 | DNA | *Arabidopsis thaliana* | |
| 882 | G2011 | PRT | *Arabidopsis thaliana* | |
| 883 | G2215 | DNA | *Arabidopsis thaliana* | Predicted polypeptide sequence is paralogous to G2216 |
| 884 | G2215 | PRT | *Arabidopsis thaliana* | Paralogous to G2216 |
| 885 | G2452 | DNA | *Arabidopsis thaliana* | |
| 886 | G2452 | PRT | *Arabidopsis thaliana* | |
| 887 | G2455 | DNA | *Arabidopsis thaliana* | |
| 888 | G2455 | PRT | *Arabidopsis thaliana* | |
| 889 | G2510 | DNA | *Arabidopsis thaliana* | |
| 890 | G2510 | PRT | *Arabidopsis thaliana* | |
| 891 | G2515 | DNA | *Arabidopsis thaliana* | |
| 892 | G2515 | PRT | *Arabidopsis thaliana* | |
| 893 | G2571 | DNA | *Arabidopsis thaliana* | |
| 894 | G2571 | PRT | *Arabidopsis thaliana* | |
| 895 | G2702 | DNA | *Arabidopsis thaliana* | |
| 896 | G2702 | PRT | *Arabidopsis thaliana* | |
| 897 | G2763 | DNA | *Arabidopsis thaliana* | |
| 898 | G2763 | PRT | *Arabidopsis thaliana* | |
| 899 | G2774 | DNA | *Arabidopsis thaliana* | |
| 900 | G2774 | PRT | *Arabidopsis thaliana* | |
| 901 | G2888 | DNA | *Arabidopsis thaliana* | Predicted polypeptide sequence is paralogous to G1991 |
| 902 | G2888 | PRT | *Arabidopsis thaliana* | Paralogous to G1991 |
| 903 | G2958 | DNA | *Arabidopsis thaliana* | |
| 904 | G2958 | PRT | *Arabidopsis thaliana* | |
| 905 | G5 | DNA | *Arabidopsis thaliana* | Predicted polypeptide sequence is paralogous to G974 |
| 906 | G5 | PRT | *Arabidopsis thaliana* | Paralogous to G974 |
| 907 | G197 | DNA | *Arabidopsis thaliana* | Predicted polypeptide sequence is paralogous to G255, G664; orthologous to G3503, G3504, G3505, G3506, G3507, G3508, G3509, G3529, G3531, G3532, G3533, G3534, G3527, G3528 |
| 908 | G197 | PRT | *Arabidopsis thaliana* | Paralogous to G255, G664; Orthologous to G3503, G3504, G3505, G3506, G3507, G3508, G3509, G3529, G3531, G3532, G3533, G3534, G3527, G3528 |
| 909 | G207 | DNA | *Arabidopsis thaliana* | Predicted polypeptide sequence is paralogous to G227, G230, G242 |
| 910 | G207 | PRT | *Arabidopsis thaliana* | Paralogous to G227, G230, G242 |
| 911 | G227 | DNA | *Arabidopsis thaliana* | Predicted polypeptide sequence is paralogous to G207, G230, G242 |
| 912 | G227 | PRT | *Arabidopsis thaliana* | Paralogous to G207, G230, G242 |
| 913 | G242 | DNA | *Arabidopsis thaliana* | Predicted polypeptide sequence is paralogous to G207, G227, G230 |
| 914 | G242 | PRT | *Arabidopsis thaliana* | Paralogous to G207, G227, G230 |
| 915 | G255 | DNA | *Arabidopsis thaliana* | Predicted polypeptide sequence is paralogous to G197, G664; orthologous to G3503, G3504, G3505, G3506, G3507, G3508, G3509, G3529, G3531, G3532, G3533, G3534, G3527, G3528 |
| 916 | G255 | PRT | *Arabidopsis thaliana* | Paralogous to G197, G664; Orthologous to G3503, G3504, G3505, G3506, G3507, G3508, |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| | | | | G3509, G3529, G3531, G3532, G3533, G3534, G3527, G3528 |
| 917 | G265 | DNA | *Arabidopsis thaliana* | Predicted polypeptide sequence is paralogous to G261 |
| 918 | G265 | PRT | *Arabidopsis thaliana* | Paralogous to G261 |
| 919 | G361 | DNA | *Arabidopsis thaliana* | Predicted polypeptide sequence is paralogous to G1995, G2826, G2838, G362, G370 |
| 920 | G361 | PRT | *Arabidopsis thaliana* | Paralogous to G1995, G2826, G2838, G362, G370 |
| 921 | G362 | DNA | *Arabidopsis thaliana* | Predicted polypeptide sequence is paralogous to G1995, G2826, G2838, G361, G370 |
| 922 | G362 | PRT | *Arabidopsis thaliana* | Paralogous to G1995, G2826, G2838, G361, G370 |
| 923 | G370 | DNA | *Arabidopsis thaliana* | Predicted polypeptide sequence is paralogous to G1995, G2826, G2838, G361, G362 |
| 924 | G370 | PRT | *Arabidopsis thaliana* | Paralogous to G1995, G2826, G2838, G361, G362 |
| 925 | G504 | DNA | *Arabidopsis thaliana* | Predicted polypeptide sequence is paralogous to G1425, G1454; orthologous to G3809 |
| 926 | G504 | PRT | *Arabidopsis thaliana* | Paralogous to G1425, G1454; Orthologous to G3809 |
| 927 | G554 | DNA | *Arabidopsis thaliana* | Predicted polypeptide sequence is paralogous to G1198, G1806, G555, G556, G558, G578, G629 |
| 928 | G554 | PRT | *Arabidopsis thaliana* | Paralogous to G1198, G1806, G555, G556, G558, G578, G629 |
| 929 | G555 | DNA | *Arabidopsis thaliana* | Predicted polypeptide sequence is paralogous to G1198, G1806, G554, G556, G558, G578, G629 |
| 930 | G555 | PRT | *Arabidopsis thaliana* | Paralogous to G1198, G1806, G554, G556, G558, G578, G629 |
| 931 | G556 | DNA | *Arabidopsis thaliana* | Predicted polypeptide sequence is paralogous to G1198, G1806, G554, G555, G558, G578, G629 |
| 932 | G556 | PRT | *Arabidopsis thaliana* | Paralogous to G1198, G1806, G554, G555, G558, G578, G629 |
| 933 | G558 | DNA | *Arabidopsis thaliana* | Predicted polypeptide sequence is paralogous to G1198, G1806, G554, G555, G556, G578, G629 |
| 934 | G558 | PRT | *Arabidopsis thaliana* | Paralogous to G1198, G1806, G554, G555, G556, G578, G629 |
| 935 | G578 | DNA | *Arabidopsis thaliana* | Predicted polypeptide sequence is paralogous to G1198, G1806, G554, G555, G556, G558, G629 |
| 936 | G578 | PRT | *Arabidopsis thaliana* | Paralogous to G1198, G1806, G554, G555, G556, G558, G629 |
| 937 | G629 | DNA | *Arabidopsis thaliana* | Predicted polypeptide sequence is paralogous to G1198, G1806, G554, G555, G556, G558, G578 |
| 938 | G629 | PRT | *Arabidopsis thaliana* | Paralogous to G1198, G1806, G554, G555, G556, G558, G578 |
| 939 | G776 | DNA | *Arabidopsis thaliana* | Predicted polypeptide sequence is paralogous to G772 |
| 940 | G776 | PRT | *Arabidopsis thaliana* | Paralogous to G772 |
| 941 | G812 | DNA | *Arabidopsis thaliana* | Predicted polypeptide sequence is paralogous to G2467 |
| 942 | G812 | PRT | *Arabidopsis thaliana* | Paralogous to G2467 |
| 943 | G997 | DNA | *Arabidopsis thaliana* | Predicted polypeptide sequence is paralogous to G1789, G1911, G2721 |
| 944 | G997 | PRT | *Arabidopsis thaliana* | Paralogous to G1789, G1911, G2721 |
| 945 | G1133 | DNA | *Arabidopsis thaliana* | Predicted polypeptide sequence is paralogous to G1137 |
| 946 | G1133 | PRT | *Arabidopsis thaliana* | Paralogous to G1137 |
| 947 | G1141 | DNA | *Arabidopsis thaliana* | Predicted polypeptide sequence is paralogous to G38 |
| 948 | G1141 | PRT | *Arabidopsis thaliana* | Paralogous to G38 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| 949 | G1198 | DNA | *Arabidopsis thaliana* | Predicted polypeptide sequence is paralogous to G1806, G554, G555, G556, G558, G578, G629 |
| 950 | G1198 | PRT | *Arabidopsis thaliana* | Paralogous to G1806, G554, G555, G556, G558, G578, G629 |
| 951 | G1335 | DNA | *Arabidopsis thaliana* | Predicted polypeptide sequence is paralogous to G652 |
| 952 | G1335 | PRT | *Arabidopsis thaliana* | Paralogous to G652 |
| 953 | G1454 | DNA | *Arabidopsis thaliana* | Predicted polypeptide sequence is paralogous to G1425, G504; orthologous to G3809 |
| 954 | G1454 | PRT | *Arabidopsis thaliana* | Paralogous to G1425, G504; Orthologous to G3809 |
| 955 | G1664 | DNA | *Arabidopsis thaliana* | Predicted polypeptide sequence is paralogous to G1062 |
| 956 | G1664 | PRT | *Arabidopsis thaliana* | Paralogous to G1062 |
| 957 | G1897 | DNA | *Arabidopsis thaliana* | Predicted polypeptide sequence is paralogous to G798 |
| 958 | G1897 | PRT | *Arabidopsis thaliana* | Paralogous to G798 |
| 959 | G1991 | DNA | *Arabidopsis thaliana* | Predicted polypeptide sequence is paralogous to G2888 |
| 960 | G1991 | PRT | *Arabidopsis thaliana* | Paralogous to G2888 |
| 961 | G2216 | DNA | *Arabidopsis thaliana* | Predicted polypeptide sequence is paralogous to G2215 |
| 962 | G2216 | PRT | *Arabidopsis thaliana* | Paralogous to G2215 |
| 963 | G2546 | DNA | *Arabidopsis thaliana* | Predicted polypeptide sequence is paralogous to G2550 |
| 964 | G2546 | PRT | *Arabidopsis thaliana* | Paralogous to G2550 |
| 965 | G2586 | DNA | *Arabidopsis thaliana* | Predicted polypeptide sequence is paralogous to G2587, G2686 |
| 966 | G2586 | PRT | *Arabidopsis thaliana* | Paralogous to G2587, G2686 |
| 967 | G2587 | DNA | *Arabidopsis thaliana* | Predicted polypeptide sequence is paralogous to G2586, G2686 |
| 968 | G2587 | PRT | *Arabidopsis thaliana* | Paralogous to G2586, G2686 |
| 969 | G2635 | DNA | *Arabidopsis thaliana* | Predicted polypeptide sequence is paralogous to G2505 |
| 970 | G2635 | PRT | *Arabidopsis thaliana* | Paralogous to G2505 |
| 971 | G2639 | DNA | *Arabidopsis thaliana* | Predicted polypeptide sequence is paralogous to G2640, G2642 |
| 972 | G2639 | PRT | *Arabidopsis thaliana* | Paralogous to G2640, G2642 |
| 973 | G2642 | DNA | *Arabidopsis thaliana* | Predicted polypeptide sequence is paralogous to G2639, G2640 |
| 974 | G2642 | PRT | *Arabidopsis thaliana* | Paralogous to G2639, G2640 |
| 975 | G2721 | DNA | *Arabidopsis thaliana* | Predicted polypeptide sequence is paralogous to G1789, G1911, G997 |
| 976 | G2721 | PRT | *Arabidopsis thaliana* | Paralogous to G1789, G1911, G997 |
| 977 | G2826 | DNA | *Arabidopsis thaliana* | Predicted polypeptide sequence is paralogous to G1995, G2838, G361, G362, G370 |
| 978 | G2826 | PRT | *Arabidopsis thaliana* | Paralogous to G1995, G2838, G361, G362, G370 |
| 979 | G2838 | DNA | *Arabidopsis thaliana* | Predicted polypeptide sequence is paralogous to G1995, G2826, G361, G362, G370 |
| 980 | G2838 | PRT | *Arabidopsis thaliana* | Paralogous to G1995, G2826, G361, G362, G370 |
| 981 | G2866 | DNA | *Arabidopsis thaliana* | Predicted polypeptide sequence is paralogous to G468 |
| 982 | G2866 | PRT | *Arabidopsis thaliana* | Paralogous to G468 |
| 983 | G3503 | DNA | *Oryza sativa* | Predicted polypeptide sequence is paralogous to G3504, G3505, G3506, G3507, G3508; orthologous to G197, G255, G664, G3509, G3529, G3531, G3532, G3533, G3534, G3527, G3528 |
| 984 | G3503 | PRT | *Oryza sativa* | Paralogous to G3504, G3505, G3506, G3507, G3508; Orthologous to G197, G255, G664, G3509, G3529, G3531, G3532, G3533, G3534, G3527, G3528 |
| 985 | G3504 | DNA | *Oryza sativa* | Predicted polypeptide sequence is paralogous to G3503, G3505, G3506, |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| | | | | G3507, G3508; orthologous to G197, G255, G664, G3509, G3529, G3531, G3532, G3533, G3534, G3527, G3528 |
| 986 | G3504 | PRT | *Oryza sativa* | Paralogous to G3503, G3505, G3506, G3507, G3508; Orthologous to G197, G255, G664, G3509, G3529, G3531, G3532, G3533, G3534, G3527, G3528 |
| 987 | G3505 | DNA | *Oryza sativa* | Predicted polypeptide sequence is paralogous to G3503, G3504, G3506, G3507, G3508; orthologous to G197, G255, G664, G3509, G3529, G3531, G3532, G3533, G3534, G3527, G3528 |
| 988 | G3505 | PRT | *Oryza sativa* | Paralogous to G3503, G3504, G3506, G3507, G3508; Orthologous to G197, G255, G664, G3509, G3529, G3531, G3532, G3533, G3534, G3527, G3528 |
| 989 | G3506 | DNA | *Oryza sativa* | Predicted polypeptide sequence is paralogous to G3503, G3504, G3505, G3507, G3508; orthologous to G197, G255, G664, G3509, G3529, G3531, G3532, G3533, G3534, G3527, G3528 |
| 990 | G3506 | PRT | *Oryza sativa* | Paralogous to G3503, G3504, G3505, G3507, G3508; Orthologous to G197, G255, G664, G3509, G3529, G3531, G3532, G3533, G3534, G3527, G3528 |
| 991 | G3507 | DNA | *Oryza sativa* | Predicted polypeptide sequence is paralogous to G3503, G3504, G3505, G3506, G3508; orthologous to G197, G255, G664, G3509, G3529, G3531, G3532, G3533, G3534, G3527, G3528 |
| 992 | G3507 | PRT | *Oryza sativa* | Paralogous to G3503, G3504, G3505, G3506, G3508; Orthologous to G197, G255, G664, G3509, G3529, G3531, G3532, G3533, G3534, G3527, G3528 |
| 993 | G3508 | DNA | *Oryza sativa* | Predicted polypeptide sequence is paralogous to G3503, G3504, G3505, G3506, G3507; orthologous to G197, G255, G664, G3509, G3529, G3531, G3532, G3533, G3534, G3527, G3528 |
| 994 | G3508 | PRT | *Oryza sativa* | Paralogous to G3503, G3504, G3505, G3506, G3507; Orthologous to G197, G255, G664, G3509, G3529, G3531, G3532, G3533, G3534, G3527, G3528 |
| 995 | G3509 | DNA | *Lycopersicon esculentum* | Predicted polypeptide sequence is orthologous to G197, G255, G664, G3503, G3504, G3505, G3506, G3507, G3508, G3529, G3531, G3532, G3533, G3534, G3527, G3528 |
| 996 | G3509 | PRT | *Lycopersicon esculentum* | Orthologous to G197, G255, G664, G3503, G3504, G3505, G3506, G3507, G3508, G3529, G3531, G3532, G3533, G3534, G3527, G3528 |
| 997 | G3527 | DNA | *Glycine max* | Predicted polypeptide sequence is paralogous to G3529, G3528; orthologous to G197, G255, G664, G3503, G3504, G3505, G3506, G3507, G3508, G3509, G3531, G3532, G3533, G3534 |
| 998 | G3527 | PRT | *Glycine max* | Paralogous to G3529, G3528; Orthologous to G197, G255, G664, |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| 999 | G3528 | DNA | *Glycine max* | Predicted polypeptide sequence is paralogous to G3529, G3527; orthologous to G197, G255, G664, G3503, G3504, G3505, G3506, G3507, G3508, G3509, G3531, G3532, G3533, G3534 |
| 1000 | G3528 | PRT | *Glycine max* | Paralogous to G3529, G3527; Orthologous to G197, G255, G664, G3503, G3504, G3505, G3506, G3507, G3508, G3509, G3531, G3532, G3533, G3534 |
| 1001 | G3529 | DNA | *Glycine max* | Predicted polypeptide sequence is paralogous to G3527, G3528; orthologous to G197, G255, G664, G3503, G3504, G3505, G3506, G3507, G3508, G3509, G3531, G3532, G3533, G3534 |
| 1002 | G3529 | PRT | *Glycine max* | Paralogous to G3527, G3528; Orthologous to G197, G255, G664, G3503, G3504, G3505, G3506, G3507, G3508, G3509, G3531, G3532, G3533, G3534 |
| 1003 | G3531 | DNA | *Zea mays* | Predicted polypeptide sequence is paralogous to G3532, G3533, G3534; orthologous to G197, G255, G664, G3503, G3504, G3505, G3506, G3507, G3508, G3509, G3529, G3527, G3528 |
| 1004 | G3531 | PRT | *Zea mays* | Paralogous to G3532, G3533, G3534; Orthologous to G197, G255, G664, G3503, G3504, G3505, G3506, G3507, G3508, G3509, G3529, G3527, G3528 |
| 1005 | G3532 | DNA | *Zea mays* | Predicted polypeptide sequence is paralogous to G3531, G3533, G3534; orthologous to G197, G255, G664, G3503, G3504, G3505, G3506, G3507, G3508, G3509, G3529, G3527, G3528 |
| 1006 | G3532 | PRT | *Zea mays* | Paralogous to G3531, G3533, G3534; Orthologous to G197, G255, G664, G3503, G3504, G3505, G3506, G3507, G3508, G3509, G3529, G3527, G3528 |
| 1007 | G3533 | DNA | *Zea mays* | Predicted polypeptide sequence is paralogous to G3531, G3532, G3534; orthologous to G197, G255, G664, G3503, G3504, G3505, G3506, G3507, G3508, G3509, G3529, G3527, G3528 |
| 1008 | G3533 | PRT | *Zea mays* | Paralogous to G3531, G3532, G3534; Orthologous to G197, G255, G664, G3503, G3504, G3505, G3506, G3507, G3508, G3509, G3529, G3527, G3528 |
| 1009 | G3534 | DNA | *Zea mays* | Predicted polypeptide sequence is paralogous to G3531, G3532, G3533; orthologous to G197, G255, G664, G3503, G3504, G3505, G3506, G3507, G3508, G3509, G3529, G3527, G3528 |
| 1010 | G3534 | PRT | *Zea mays* | Paralogous to G3531, G3532, G3533; Orthologous to G197, G255, G664, G3503, G3504, G3505, G3506, G3507, G3508, G3509, G3529, G3527, G3528 |

TABLE 9-continued

Homologs and Other Related Genes of Representative *Arabidopsis* Transcription Factor Genes Identified using BLAST

| SEQ ID NO: | GID No: | Polynucleotide (DNA) or polypeptide (PRT) | Species from Which Homologous Sequence is Derived | Relationship of SEQ ID NO: to Other Genes |
|---|---|---|---|---|
| 1011 | G3809 | DNA | Oryza sativa | Predicted polypeptide sequence is orthologous to G1425, G1454, G504 |
| 1012 | G3809 | PRT | Oryza sativa | Orthologous to G1425, G1454, G504 |

Molecular Modeling

Another means that may be used to confirm the utility and function of transcription factor sequences that are orthologous or paralogous to presently disclosed transcription factors is through the use of molecular modeling software. Molecular modeling is routinely used to predict polypeptide structure, and a variety of protein structure modeling programs, such as "Insight II" (Accelrys, Inc.) are commercially available for this purpose. Modeling can thus be used to predict which residues of a polypeptide can be changed without altering function (Crameri et al. (2003) U.S. Pat. No. 6,521,453). Thus, polypeptides that are sequentially similar can be shown to have a high likelihood of similar function by their structural similarity, which may, for example, be established by comparison of regions of superstructure. The relative tendencies of amino acids to form regions of superstructure (for example, helixes and β-sheets) are well established. For example, O'Neil et al. ((1990) *Science* 250: 646-651) have discussed in detail the helix forming tendencies of amino acids. Tables of relative structure forming activity for amino acids can be used as substitution tables to predict which residues can be functionally substituted in a given region, for example, in DNA-binding domains of known transcription factors and equivalogs. Homologs that are likely to be functionally similar can then be identified.

Of particular interest is the structure of a transcription factor in the region of its conserved domains, such as those identified in Table 1 and Table 3. Structural analyses may be performed by comparing the structure of the known transcription factor around its conserved domain with those of orthologs and paralogs. Analysis of a number of polypeptides within a transcription factor group or clade, including the functionally or sequentially similar polypeptides provided in the Sequence Listing, may also provide an understanding of structural elements required to regulate transcription within a given family.

EXAMPLES

The invention, now being generally described, will be more readily understood by reference to the following examples, which are included merely for purposes of illustration of certain aspects and embodiments of the present invention and are not intended to limit the invention. It will be recognized by one of skill in the art that a transcription factor that is associated with a particular first trait may also be associated with at least one other, unrelated and inherent second trait which was not predicted by the first trait.

The complete descriptions of the traits associated with each polynucleotide of the invention are fully disclosed in Examples VIII, IX and X.

Example I: Full Length Gene Identification and Cloning

Putative transcription factor sequences (genomic or ESTs) related to known transcription factors were identified in the *Arabidopsis thaliana* GenBank database using the tblastn sequence analysis program using default parameters and a P-value cutoff threshold of −4 or −5 or lower, depending on the length of the query sequence. Putative transcription factor sequence hits were then screened to identify those containing particular sequence strings. If the sequence hits contained such sequence strings, the sequences were confirmed as transcription factors.

Alternatively, *Arabidopsis thaliana* cDNA libraries derived from different tissues or treatments, or genomic libraries were screened to identify novel members of a transcription family using a low stringency hybridization approach. Probes were synthesized using gene specific primers in a standard PCR reaction (annealing temperature 60° C.) and labeled with $^{32}$P dCTP using the High Prime DNA Labeling Kit (Roche Diagnostics Corp., Indianapolis, Ind.). Purified radiolabelled probes were added to filters immersed in Church hybridization medium (0.5 M NaPO$_4$ pH 7.0, 7% SDS, 1% w/v bovine serum albumin) and hybridized overnight at 60° C. with shaking. Filters were washed two times for 45 to 60 minutes with 1×SCC, 1% SDS at 60° C.

To identify additional sequence 5' or 3' of a partial cDNA sequence in a cDNA library, 5' and 3' rapid amplification of cDNA ends (RACE) was performed using the MARATHON cDNA amplification kit (Clontech, Palo Alto, Calif.). Generally, the method entailed first isolating poly(A) mRNA, performing first and second strand cDNA synthesis to generate double-stranded cDNA, blunting cDNA ends, followed by ligation of the MARATHON Adaptor to the cDNA to form a library of adaptor-ligated ds cDNA.

Gene-specific primers were designed to be used along with adaptor specific primers for both 5' and 3' RACE reactions. Nested primers, rather than single primers, were used to increase PCR specificity. Using 5' and 3' RACE reactions, 5' and 3' RACE fragments were obtained, sequenced and cloned. The process can be repeated until 5' and 3' ends of the full-length gene were identified. Then the full-length cDNA was generated by PCR using primers specific to 5' and 3' ends of the gene by end-to-end PCR.

Example II: Construction of Expression Vectors

The sequence was amplified from a genomic or cDNA library using primers specific to sequences upstream and downstream of the coding region. The expression vector was pMEN20 or pMEN65, which are both derived from pMON316 (Sanders et al. (1987) *Nucleic Acids Res.* 15:1543-1558) and contain the CaMV 35S promoter to express transgenes. To clone the sequence into the vector, both pMEN20 and the amplified DNA fragment were digested separately with SalI and NotI restriction enzymes at 37° C. for 2 hours. The digestion products were subject to electrophoresis in a 0.8% agarose gel and visualized by ethidium bromide staining. The DNA fragments containing the sequence and the linearized plasmid were excised and purified by using a QIAQUICK gel extraction kit (Qiagen, Valencia Calif.). The fragments of interest were ligated at a ratio of 3:1 (vector to insert). Ligation reactions using T4 DNA ligase (New England Biolabs, Beverly Mass.) were carried out at 16° C. for 16 hours. The ligated DNAs were transformed into competent cells of the *E. coli* strain DH5α by using the heat shock method. The transformations were plated on LB plates containing 50 mg/l kanamycin (Sigma Chemical Co. St. Louis Mo.). Individual colonies were grown overnight in five milliliters of LB broth containing 50 mg/l kanamycin at 37° C. Plasmid DNA was purified by using Qiaquick Mini Prep kits (Qiagen).

Example III: Transformation of *Agrobacterium* with the Expression Vector

After the plasmid vector containing the gene was constructed, the vector was used to transform *Agrobacterium tumefaciens* cells expressing the gene products. The stock of *Agrobacterium tumefaciens* cells for transformation was made as described by Nagel et al. (1990) *FEMS Microbiol Letts*. 67: 325-328. *Agrobacterium* strain ABI was grown in 250 ml LB medium (Sigma) overnight at 28° C. with shaking until an absorbance over 1 cm at 600 nm ($A_{600}$) of 0.5-1.0 was reached. Cells were harvested by centrifugation at 4,000×g for 15 min at 4° C. Cells were then resuspended in 250 µl chilled buffer (1 mM HEPES, pH adjusted to 7.0 with KOH). Cells were centrifuged again as described above and resuspended in 125 µl chilled buffer. Cells were then centrifuged and resuspended two more times in the same HEPES buffer as described above at a volume of 100 µl and 750 µl, respectively. Resuspended cells were then distributed into 40 µl aliquots, quickly frozen in liquid nitrogen, and stored at −80° C.

*Agrobacterium* cells were transformed with plasmids prepared as described above following the protocol described by Nagel et al. (1990) supra. For each DNA construct to be transformed, 50-100 ng DNA (generally resuspended in 10 mM Tris-HCl, 1 mM EDTA, pH 8.0) was mixed with 40 µl of *Agrobacterium* cells. The DNA/cell mixture was then transferred to a chilled cuvette with a 2 mm electrode gap and subject to a 2.5 kV charge dissipated at 25 µF and 200 µF using a Gene Pulser II apparatus (Bio-Rad, Hercules, Calif.). After electroporation, cells were immediately resuspended in 1.0 ml LB and allowed to recover without antibiotic selection for 2-4 hours at 28° C. in a shaking incubator. After recovery, cells were plated onto selective medium of LB broth containing 100 µg/ml spectinomycin (Sigma) and incubated for 24-48 hours at 28° C. Single colonies were then picked and inoculated in fresh medium. The presence of the plasmid construct was verified by PCR amplification and sequence analysis.

Example IV: Transformation of *Arabidopsis* Plants with *Agrobacterium tumefaciens* with Expression Vector After transformation of *Agrobacterium tumefaciens* with plasmid vectors containing the gene, single *Agrobacterium* colonies were identified, propagated, and used to transform *Arabidopsis* plants. Briefly, 500 ml cultures of LB medium containing 50 mg/l kanamycin were inoculated with the colonies and grown at 28° C. with shaking for 2 days until an optical absorbance at 600 nm wavelength over 1 cm ($A_{600}$) of >2.0 is reached. Cells were then harvested by centrifugation at 4,000×g for 10 min, and resuspended in infiltration medium (½× Murashige and Skoog salts (Sigma), 1× Gamborg's B-5 vitamins (Sigma), 5.0% (w/v) sucrose (Sigma), 0.044 µM benzylamino purine (Sigma), 200 µl/l Silwet L-77 (Lehle Seeds)) until an $A_{600}$ of 0.8 was reached.

Prior to transformation, *Arabidopsis thaliana* seeds (ecotype Columbia) were sown at a density of ~10 plants per 4" pot onto Pro-Mix BX potting medium (Hummert International) covered with fiberglass mesh (18 mm×16 mm). Plants were grown under continuous illumination (50-75 µE/m²/sec) at 22-23° C. with 65-70% relative humidity. After about 4 weeks, primary inflorescence stems (bolts) are cut off to encourage growth of multiple secondary bolts. After flowering of the mature secondary bolts, plants were prepared for transformation by removal of all siliques and opened flowers.

The pots were then immersed upside down in the mixture of *Agrobacterium* infiltration medium as described above for 30 sec, and placed on their sides to allow draining into a 1'×2' flat surface covered with plastic wrap. After 24 h, the plastic wrap was removed and pots are turned upright. The immersion procedure was repeated one week later, for a total of two immersions per pot. Seeds were then collected from each transformation pot and analyzed following the protocol described below.

Example V: Identification of *Arabidopsis* Primary Transformants

Seeds collected from the transformation pots were sterilized essentially as follows. Seeds were dispersed into in a solution containing 0.1% (v/v) Triton X-100 (Sigma) and sterile water and washed by shaking the suspension for 20 min. The wash solution was then drained and replaced with fresh wash solution to wash the seeds for 20 min with shaking. After removal of the ethanol/detergent solution, a solution containing 0.1% (v/v) Triton X-100 and 30% (v/v) bleach (CLOROX; Clorox Corp. Oakland Calif.) was added to the seeds, and the suspension was shaken for 10 min. After removal of the bleach/detergent solution, seeds were then washed five times in sterile distilled water. The seeds were stored in the last wash water at 4° C. for 2 days in the dark before being plated onto antibiotic selection medium (1× Murashige and Skoog salts (pH adjusted to 5.7 with 1M KOH), 1× Gamborg's B-5 vitamins, 0.9% phytagar (Life Technologies), and 50 mg/l kanamycin). Seeds were germinated under continuous illumination (50-75 µE/m²/sec) at 22-23° C. After 7-10 days of growth under these conditions, kanamycin resistant primary transformants (T1 generation) were visible and obtained. These seedlings were transferred first to fresh selection plates where the seedlings continued to grow for 3-5 more days, and then to soil (Pro-Mix BX potting medium).

Primary transformants were crossed and progeny seeds ($T_2$) collected; kanamycin resistant seedlings were selected and analyzed. The expression levels of the recombinant polynucleotides in the transformants varies from about a 5% expression level increase to a least a 100% expression level increase. Similar observations are made with respect to polypeptide level expression.

Example VI: Identification of *Arabidopsis* Plants with Transcription Factor Gene Knockouts The screening of insertion mutagenized *Arabidopsis* collections for null mutants in a known target gene was essentially as described in Krysan et al. (1999) *Plant Cell* 11:

2283-2290. Briefly, gene-specific primers, nested by 5-250 base pairs to each other, were designed from the 5' and 3' regions of a known target gene. Similarly, nested sets of primers were also created specific to each of the T-DNA or transposon ends (the "right" and "left" borders). All possible combinations of gene specific and T-DNA/transposon primers were used to detect by PCR an insertion event within or close to the target gene. The amplified DNA fragments were then sequenced which allows the precise determination of the T-DNA/transposon insertion point relative to the target gene. Insertion events within the coding or intervening sequence of the genes were deconvoluted from a pool comprising a plurality of insertion events to a single unique mutant plant for functional characterization. The method is described in more detail in Yu and Adam, U.S. application Ser. No. 09/177,733 filed Oct. 23, 1998.

Example VII: Identification of Modified Phenotypes in Overexpression or Gene Knockout Plants

*Arabidopsis thaliana* ecotype Columbia (Col-0) was used to create all overexpressing lines. The control plants for the assay were Col-0 plants transformed with an empty transformation vector (pMEN65).
Microarray Experiments In some instances, expression patterns of the stress-induced genes may be monitored by microarray experiments. In these experiments, cDNAs are generated by PCR and resuspended at a final concentration of ~100 ng/µl in 3×SSC or 150 mM Na-phosphate (Eisen and Brown (1999) *Methods Enzymol.* 303: 179-205). The cDNAs are spotted on microscope glass slides coated with polylysine. The prepared cDNAs are aliquoted into 384 well plates and spotted on the slides using, for example, an x-y-z gantry (OmniGrid) which may be purchased from GeneMachines (Menlo Park, Calif.) outfitted with quill type pins which may be purchased from Telechem International (Sunnyvale, Calif.). After spotting, the arrays are cured for a minimum of one week at room temperature, rehydrated and blocked following the protocol recommended by Eisen and Brown (1999) supra.

Sample total RNA (10 µg) samples are labeled using fluorescent Cy3 and Cy5 dyes. Labeled samples are resuspended in 4×SSC/0.03% SDS/4 µg salmon sperm DNA/2 µg tRNA/50 mM Na-pyrophosphate, heated for 95° C. for 2.5 minutes, spun down and placed on the array. The array is then covered with a glass coverslip and placed in a sealed chamber. The chamber is then kept in a water bath at 62° C. overnight. The arrays are washed as described in Eisen and Brown (1999) supra and scanned on a General Scanning 3000 laser scanner. The resulting files are subsequently quantified using IMAGENE, software (BioDiscovery, Los Angeles Calif.).

RT-PCR experiments may be performed to identify those genes induced after exposure to abiotic stresses. Generally, the gene expression patterns from ground plant leaf tissue is examined.

Reverse transcriptase PCR was conducted using gene specific primers within the coding region for each sequence identified. The primers were designed near the 3' region of each DNA binding sequence initially identified.

Total RNA from these ground leaf tissues was isolated using the CTAB extraction protocol. Once extracted total RNA was normalized in concentration across all the tissue types to ensure that the PCR reaction for each tissue received the same amount of cDNA template using the 28S band as reference. Poly(A+) RNA was purified using a modified protocol from the Qiagen OLIGOTEX purification kit batch protocol. cDNA was synthesized using standard protocols. After the first strand cDNA synthesis, primers for Actin 2 were used to normalize the concentration of cDNA across the tissue types. Actin 2 is found to be constitutively expressed in fairly equal levels across the tissue types being investigated.

For RT PCR, cDNA template was mixed with corresponding primers and Taq DNA polymerase. Each reaction consisted of 0.2 µl cDNA template, 2 µl 10× Tricine buffer, 2 µl 10× Tricine buffer and 16.8 µl water, 0.05 µl Primer 1, 0.05 µl, Primer 2, 0.3 µl Taq DNA polymerase and 8.6 µl water.

The 96 well plate is covered with microfilm and set in the thermocycler to start the reaction cycle. By way of illustration, the reaction cycle may comprise the following steps:
STEP 1: 93° C. for 3 minutes;
STEP 2: 93° C. for 30 seconds;
STEP 3: 65° C. for 1 minute;
STEP 4: 72° C. for 2 minutes;
STEPS 2, 3 and 4 are repeated for 28 cycles;
STEP 5: 72° C. for 5 minutes; and
STEP 6 4° C.

To amplify more products, for example, to identify genes that have very low expression, additional steps may be performed: the following method illustrates a method that may be used in this regard. the PCR plate is placed back in the thermocycler for 8 more cycles of Steps 2-4.
STEP 2 93° C. for 30 seconds;
STEP 3 65° C. for 1 minute;
STEP 4 72° C. for 2 minutes, repeated for 8 cycles; and
STEP 5 4° C.

Eight microliters of PCR product and 1.5 µl of loading dye are loaded on a 1.2% agarose gel for analysis after 28 cycles and 36 cycles. Expression levels of specific transcripts are considered low if they were only detectable after 36 cycles of PCR. Expression levels are considered medium or high depending on the levels of transcript compared with observed transcript levels for an internal control such as actin2. Transcript levels are determined in repeat experiments and compared to transcript levels in control (e.g., non-transformed) plants.
Abiotic Stress Assays Modified phenotypes observed for particular overexpressor plants may include increased biomass, and/or increased or decreased abiotic stress tolerance or resistance. For a particular overexpressor that shows a less beneficial characteristic, such as reduced abiotic stress tolerance or resistance, it may be more useful to select a plant with a decreased expression of the particular transcription factor. For a particular knockout that shows a less beneficial characteristic, such as decreased abiotic stress tolerance, it may be more useful to select a plant with an increased expression of the particular transcription factor.

The germination assays in this example followed modifications of the same basic protocol. Sterile seeds were sown on the conditional media listed below. Plates were incubated at 22° C. under 24-hour light (120-130 µEin/m$^2$/s) in a growth chamber. Evaluation of germination and seedling vigor was conducted 3 to 15 days after planting. The basal media was 80% Murashige-Skoog medium (MS)+vitamins.

For stress experiments conducted with more mature plants, seeds were germinated and grown for seven days on MS+vitamins+1% sucrose at 22° C. and then transferred to cold and heat stress conditions. The plants were either exposed to cold stress (6 hour exposure to 4-8° C.), or heat stress (32° C. was applied for five days, after which the plants were transferred back 22° C. for recovery and evaluated after 5 days relative to controls not exposed to the depressed or elevated temperature).

The salt stress assays were intended to find genes that confer better germination, seedling vigor or growth in high salt. Evaporation from the soil surface causes upward water movement and salt accumulation in the upper soil layer where the seeds are placed. Thus, germination normally takes place at a salt concentration much higher than the mean salt concentration of in the whole soil profile. Plants differ in their tolerance to NaCl depending on their stage of development, therefore seed germination, seedling vigor, and plant growth responses were evaluated.

Osmotic stress assays (including NaCl and mannitol assays) were conducted to determine if an osmotic stress phenotype was NaCl-specific or if it was a general osmotic stress related phenotype. Plants tolerant to osmotic stress could also have more tolerance to drought and/or freezing.

For salt and osmotic stress germination experiments, the medium was supplemented with 150 mM NaCl or 300 mM mannitol. Growth regulator sensitivity assays were performed in MS media, vitamins, and either 0.3 μM ABA, 9.4% sucrose, or 5% glucose.

Experiments were performed to identify those transformants that exhibited modified sugar-sensing. For such studies, seeds from transformants were germinated on high sugar-containing media (5% glucose, 9.4% sucrose) that normally partially restrict hypocotyl elongation. Plants with altered sugar sensing may have either longer or shorter hypocotyls than normal plants when grown on this media. Additionally, other plant traits may be varied such as root mass. Sugar sensing assays were intended to find genes involved in sugar sensing by germinating seeds on high concentrations of sucrose and glucose and looking for degrees of hypocotyl elongation. The germination assay on mannitol controlled for responses related to osmotic stress. Sugars are key regulatory molecules that affect diverse processes in higher plants including germination, growth, flowering, senescence, sugar metabolism and photosynthesis. Sucrose is the major transport form of photosynthate and its flux through cells has been shown to affect gene expression and alter storage compound accumulation in seeds (source-sink relationships). Glucose-specific hexose-sensing has also been described in plants and is implicated in cell division and repression of "famine" genes (photosynthetic or glyoxylate cycles).

Temperature stress assays were carried out to find genes that confer better germination, seedling vigor or plant growth under temperature stress (cold, freezing and heat). Temperature stress cold germination experiments were carried out at 8° C. Heat stress germination experiments were conducted at 32° C. to 37° C. for 6 hours of exposure.

Soil-based drought screens were performed with *Arabidopsis* plants overexpressing the transcription factors listed in the Sequence Listing. Seeds from wild-type *Arabidopsis* plants, or plants overexpressing a polypeptide of the invention, were stratified for three days at 4° C. in 0.1% agarose. Fourteen seeds of each overexpressor or wild-type were then sown in three inch clay pots containing a 50:50 mix of vermiculite:perlite topped with a small layer of MetroMix 200 and grown for fifteen days under 24 hr light. Pots containing wild-type and overexpressing seedlings were placed in flats in random order. Drought stress was initiated by placing pots on absorbent paper for seven to eight days. The seedlings were considered to be sufficiently stressed when the majority of the pots containing wild-type seedlings within a flat had become severely wilted. Pots were then re-watered and survival was scored four to seven days later.

Plants were ranked against wild-type controls for each of two criteria: tolerance to the drought conditions and recovery (survival) following re-watering At the end of the initial drought period, each pot was assigned a numeric value score depending on the above criteria. Scores of 0-6 were assigned (Table 11), with a low value of "0" assigned to plants with an extremely poor appearance (i.e., the plants were uniformly brown) and a value of "6" given to plants that were rated very healthy in appearance (i.e., the plants were all green). After the plants were rewatered and incubated an additional four to seven days, the plants were reevaluated to indicate the degree of recovery from the water deprivation treatment.

An analysis was then conducted to determine which plants best survived water deprivation, identifying the transgenes that consistently conferred drought-tolerant phenotypes and their ability to recover from this treatment. The analysis was performed by comparing overall and within-flat tabulations with a set of statistical models to account for variations between batches. Several measures of survival were tabulated, including: (a) the average proportion of plants surviving relative to wild-type survival within the same flat; (b) the median proportion surviving relative to wild-type survival within the same flat; (c) the overall average survival (taken over all batches, flats, and pots); (d) the overall average survival relative to the overall wild-type survival; and (e) the average visual score of plant health before rewatering.

Analysis of Flowering Time

Flowering time was measured by the number of rosette leaves present when a visible inflorescence of approximately 3 cm is apparent. Rosette and total leaf number on the progeny stem are tightly correlated with the timing of flowering (Koornneef et al. (1991) *Mol. Gen. Genet.* 229: 57-66). The vernalization response was also measured. For vernalization treatments, seeds were sown to MS agar plates, sealed with micropore tape, and placed in a 4° C. cold room with low light levels for 6-8 weeks. The plates were then transferred to the growth rooms alongside plates containing freshly sown non-vernalized controls. Rosette leaves were counted when a visible inflorescence of approximately 3 cm was apparent.

C/N Sensing Assays

Germination assays were conducted to monitor the effects of C on N signaling through anthocyanin production on high sucrose plus and minus glutamine (Hsieh et al, (1998) *Proc. Natl. Acad. Sci.* USA. 95: 13965-13970).

For overexpression lines examined in the assay, the screen was primarily performed on a seed lot comprised of seed mixed together from each of three independent primary transformants. These seed batches were segregating, but selection was not performed to avoid the extra stress that might be associated with kanamycin selection. In the case of knockout (KO) lines, the screen was performed on seed from plant(s) homozygous for a T-DNA insertion within the gene of interest. Lines that gave positive results in our previous studies were included here as positive controls.

All assays were designed to detect plants that were more tolerant or less tolerant of an alteration in C/N balance brought about by an increase in sucrose levels in the absence of a nitrogen source. Lines were scored as tolerant if they accumulated lower levels of anthocyanins than controls and sensitive if they accumulated higher levels of anthocyanins than controls. The general vigor and size of the seedlings compared to controls was also assessed.

Prior to plating, seed for all experiments were surface sterilized and prepared for germination by:

1. a 5 minute incubation with mixing in 70% ethanol;
2. a 20 minute incubation with mixing in 30% bleach, 0.01% triton-X 100;
3. five rinses with sterile water; and
4. seeds are re-suspended in 0.1% sterile agarose and stratified at 4° C. for 3 days.

The sterile seeds were then sown onto plates containing media based on 80% MS without a nitrogen source. For C/N assays, the media contained 3% sucrose. The –N/+Gln media was identical but was supplemented with 1 mM glutamine. Plates were incubated in a 24-hour light C (120-130 µEins$^{-2}$ m$^{-1}$) growth chamber at 22° C. Evaluation of germination and seedling vigor was done five days after planting for C/N assays. The production of less anthocyanin on these media is generally associated with increased tolerance to nitrogen limitation, and a transgene responsible for the altered response is likely involved in the plant's ability to perceive their carbon and nitrogen status.

Data was recorded for all phenotypes observed, regardless of their strength, based on the assumption that any lead could potentially result in a product either after a period of development or improvement, or when used in combination with another gene involved in the particular stress response pathway.

All scores presented in the result lists (other than wild-type) were based on data from two independent experiments on the seed batches, assuming sufficient seed was available to repeat the experiment twice.

Shade Tolerance Assays

The shade avoidance response was determined by the perception of light quality. We used an assay which detects alterations in the mechanisms that plants use to sense light quality and presumably activate the signal transduction cascades that regulate a shade avoidance response. Seeds were germinated under white light versus light deficient in the red portion of the visible spectrum. In a natural setting, reflected or transmitted light would be deficient in both the red and blue portions of the visible spectrum. However, because shading is detected using phytochrome to sense the R:FR ratio in light, we mimicked the effect of shading by using a filter designed to prevent only the transmission of red wavelengths (to mimic loss of red light caused by shading). To determine whether the mechanisms used to sense shading were altered, we exploited the observation that seedlings of wild-type plants grown under light deficient in red wavelengths have extended hypocotyls. Plants overexpressing genes that produce short hypocotyls under these conditions and exhibit a shade tolerance phenotype are candidates for further examination in more rigorous studies looking at components such as yield under high densities in greenhouse studies.

The assay was intended to associate a transcription factor with shade avoidance control mechanisms. All data were recorded, regardless of phenotype strength, based on the assumption that any lead (or its related paralogs/orthologs) could potentially result in a product either after a period of development or improvement, or when used in combination with another gene involved in the particular stress response pathway.

*Arabidopsis thaliana* ecotype Columbia (Col-0) was used to create all overexpressing lines. The control plants for the assay were Col-0 plants transformed with an empty transformation vector (pMEN65).

For overexpression lines examined in the assay, the screen was primarily performed on a seed lot comprised of seed mixed together from each of three independent primary transformants. These seed batches were segregating, but selection was not performed to avoid the extra stress that might be associated with kanamycin selection. In the case of knockout (KO) lines, the screen was performed on seed from plant(s) homozygous for a T-DNA insertion within the gene of interest.

Prior to plating, seed for all experiments were surface sterilized in the following manner:
1. 5 minute incubation with mixing in 70% ethanol
2. 20 minute incubation with mixing in 30% bleach, 0.01% triton-X 100
3. 5× rinses with sterile water
4. Seeds are re-suspended in 0.1% sterile agarose and stratified at 4° C. for 3 days.

The basal media onto which *Arabidopsis* seeds were plated comprised 80% MS+Vitamins. For shade avoidance assays, plates were incubated at 22° C. under 24-hour light (about 50 µEinsteins$^{-2}$ m$^{-1}$) under both white light (control) and under light depleted in red wavelengths. Seedlings were grown in a chamber deficient in red light versus a standard white light chamber. The assay was designed to detect plants that were more tolerant of the low R:FR conditions. The growth chamber used in the shade avoidance screen contained a filter that effectively removed wavelengths in the red region of the visible light spectrum. Seedlings were assessed for shade tolerance at 7 days.

Shade tolerance was scored by visually observing differences in hypocotyl length compared with control seedlings grown under white light and grown under light lacking the red wavelengths.

Examples of genes and homologs that confer significant improvements to knockout or overexpressing plants are noted below. Experimental observations made by us with regard to specific genes whose expression has been modified in overexpressing or knock-out plants, and potential applications based on these observations, are also presented. In most cases, the conserved domains can be determined and located in each of the sequences provided below with the protein BLAST (BLASTp) page of the NCBI Conserved Domain Database, presently found at: blast.ncbi.nlm.nih.gov/Blast.cgi. (Marchler-Bauer A et al. (2009) *Nucleic Acids Res.* 37(D): 205-210; Marchler-Bauer and Bryant (2004) *Nucleic Acids Res.* 32(W): 327-331).

Example VIII: Results of Drought Stress Analyses

This example provides experimental evidence for increased abiotic stress tolerance controlled by transcription factor polypeptides and polypeptides of the invention.

Results:

As noted below, overexpression of G2133, G1274, G922, G2999, G3086, G354, G1792, G2053, G975, G1069, G916, G1820, G2701, G47, G2854, G2789, G634, G175, G2839, G1452, G3083, G489, G303, G2992, and G682 was shown to increase drought stress tolerance in plants. A number of orthologs of some of these sequences were also able to increase abiotic stress tolerance, as noted below.

The G47 Clade of Transcription Factor Polypeptides
G47 (SEQ ID NO: 1 and 2)

G47 corresponds to gene T22J18.2 (AAC25505). No information is available about the function(s) of G47. G47 and closely-related clade member sequences each comprise a conserved AP2 DNA binding domain that is expected to function in a similar manner in each of these related sequences, that is, by playing a central role in transcriptional regulation and in the conferring of shared traits.

Experimental Observations.

The function of G47 was studied using transgenic *Arabidopsis* plants in which the gene was expressed under the control of the 35S promoter. Overexpression of G47 resulted in a variety of morphological and physiological phenotypic alterations.

35S::G47 plants showed enhanced tolerance to osmotic stress; osmotic stress assays were conducted using growth medium containing polyethylene glycol (PEG). After germination, the seedlings of 35S::G47 overexpressing lines generally appeared larger and had more root growth than wild-type control seedlings.

As would be predicted by these osmotic stress assays, G47 plants also showed enhanced survival and drought tolerance in a soil-based drought assay.

Overexpression of G47 also produced a substantial delay in flowering time and caused a marked change in shoot architecture. 35S::G47 transformants were small at early stages and switched to flowering more than a week later than wild-type controls (continuous light conditions). Interestingly, the inflorescences from these plants appeared thick and fleshy, had reduced apical dominance, and exhibited reduced internode elongation leading to a short compact stature. The branching pattern of the stems also appeared abnormal, with the primary shoot becoming 'kinked' at each coflorescence node. Additionally, the plants showed slightly reduced fertility and formed rather small siliques that were borne on short pedicels and held vertically, close against the stem.

Additional alterations were detected in the inflorescence stems of 35S::G47 plants. Stem sections from T2-21 and T2-24 plants were of wider diameter, and had large irregular vascular bundles containing a much greater number of xylem vessels than wild type. Furthermore some of the xylem vessels within the bundles appeared narrow and were possibly more lignified than were those of controls.

G47 was expressed at higher levels in rosette leaves, and transcripts can be detected in other tissues (flower, embryo, silique, and germinating seedling), but apparently not in roots.

Utilities.

G47 or its equivalogs can be used to increase the tolerance of plants to drought and to other osmotic stresses. G47 or its equivalogs could also be used to manipulate flowering time, to modify plant architecture and stem structure, including development of vascular tissues and lignin content. The use of G47 or its equivalogs from tree species could offer the potential for modulating lignin content. This might allow the quality of wood used for furniture or construction to be improved. G47 equivalogs include, for example, *Arabidopsis thaliana* SEQ ID NO: 12 (G2133); *Oryza sativa* (*japonica* cultivar-group) SEQ ID NOs: 98 (G3649), SEQ ID NO: 100 (G3651), and SEQ ID NO: 90 (G3644); *Glycine max* SEQ ID NO: 88 (G3643); *Zinnia elegans* SEQ ID NO: 96 (G3647); *Brassica rapa* subsp. *Pekinensis* SEQ ID NO: 92 (G3645); and *Brassica oleracea* SEQ ID NO: 94 (G3646).

G2133 (SEQ ID NO: 11 and 12)

G2133 is a paralog of G47. G2133 corresponds to gene F26A9.11 (AAF23336). No information is available about the function(s) of G2133. G2133 and closely-related clade member sequences each comprise a conserved AP2 DNA-binding domain that is expected to function in a similar manner in each of these related sequences, that is, by playing a central role in transcriptional regulation and in the conferring of shared traits.

Experimental Observations.

The function of G2133 was studied using transgenic *Arabidopsis* plants in which the gene was expressed under the control of the 35S promoter.

G2133 expression was detected in a variety of tissues: flower, leaf, embryo, and silique samples. Its expression might be altered by several conditions, including auxin treatment, osmotic stress, and *Fusarium* infection. Overexpression of G2133 caused a variety of alterations in plant growth and development: delayed flowering, altered inflorescence architecture, and a decrease in overall size and fertility.

At early stages, 35S::G2133 transformants were markedly smaller than controls and displayed curled, dark-green leaves. Most of these plants remained in a vegetative phase of development substantially longer than controls, and produced an increased number of leaves before bolting. In the most severely affected plants, bolting occurred more than a month later than in wild type (24-hour light). In addition, the plants displayed a reduction in apical dominance and formed large numbers of shoots simultaneously, from the axils of rosette leaves. These inflorescence stems had short internodes, and carried increased numbers of cauline leaf nodes, giving them a very leafy appearance. The fertility of 35S::G2133 plants was generally very low. In addition, G2133 overexpressing lines were found to be more resistant to the herbicide glyphosate in initial and repeat experiments.

No alterations were detected in 35S::G2133 plants in the biochemical analyses that were performed.

G2133 is a paralog of G47, the latter having been known from earlier studies to confer a drought tolerance phenotype when overexpressed. It was thus not surprising when G2133 was also shown to induce drought tolerance in a number of 35S::G2133 lines challenged in soil-based drought assays (Tables 11 and 12). Experiments comparing the recovery of wild-type controls and two lines of *Arabidopsis* plants overexpressing G2133 (a paralog of G47) from a drought treatment were conducted under constant light. The 35S::G2133 and control lines were grown in pots with each pot containing several plants. All were deprived of water for eight days, and then re-watered. After re-watering, all of the plants of both G2133 overexpressor lines became reinvigorated, and all of the control plants died or were severely affected by the drought treatment (Table 12).

Utilities.

G2133 and its equivalogs can be used to increase the tolerance of plants to drought and to other osmotic stresses. G2133 could also be used for the generation of glyphosate resistant plants, and to increase plant resistance to oxidative stress. G2133 equivalogs include, for example, *Arabidopsis thaliana* SEQ ID NO: 2 (G47); *Oryza sativa* (*japonica* cultivar-group) SEQ ID NO: 98 (G3649), SEQ ID NO: 100 (G3651), and SEQ ID NO: 90 (G3644); *Glycine max* SEQ ID NO: 88 (G3643); *Zinnia elegans* SEQ ID NO: 96 (G3647); *Brassica rapa* subsp. *Pekinensis* SEQ ID NO: 92 (G3645); and *Brassica oleracea* SEQ ID NO: 94 (G3646).

G3643 (SEQ ID NO: 87 and 88)

G3643 is a soy ortholog of G47 and G2133. G3643 and closely-related clade member sequences each comprise a conserved AP2 DNA-binding domain that is expected to function in a similar manner in each of these related sequences, that is, by playing a central role in transcriptional regulation and in the conferring of shared traits.

Experimental Observations.

The function of G3643 was studied using transgenic *Arabidopsis* plants in which the gene was expressed under the control of the 35S promoter.

G3643-overexpressing *Arabidopsis* plants were more tolerant to cold than wild-type control plants grown under similar conditions in plate-based germination assays. One of these lines was also more tolerant to desiccation and growth in cold conditions in plate-based assays.

Utilities.

G3643 or its equivalogs can be used to increase the tolerance of plants to cold conditions and low water conditions, including drought.

G3644 (SEQ ID NO: 89 and 90)

G3644 is a rice ortholog of G47 and G2133. G3644 and closely-related clade member sequences each comprise a conserved AP2 DNA-binding domain that is expected to function in a similar manner in each of these related sequences, that is, by playing a central role in transcriptional regulation and in the conferring of shared traits.

Experimental Observations.

The function of G3644 was studied using transgenic *Arabidopsis* plants in which the gene was expressed under the control of the 35S promoter.

Several G3644-overexpressing *Arabidopsis* plants were found to be more tolerant to desiccation than wild-type control plants grown under similar conditions in plate based-assays. Two lines were shown to be more salt tolerant than wild type.

Utilities.

G3644 or its equivalogs can be used to increase the tolerance of plants to high salt and low water conditions, including drought.

G3649 (SEQ ID NO: 97 and 98)

G3649 is a rice ortholog of G47 and G2133. G3649 and closely-related clade member sequences each comprise a conserved AP2 DNA-binding domain that is expected to function in a similar manner in each of these related sequences, that is, by playing a central role in transcriptional regulation and in the conferring of shared traits.

Experimental Observations.

The function of G3649 was studied using transgenic *Arabidopsis* plants in which the gene was expressed under the control of the 35S promoter.

Several G3649-overexpressing *Arabidopsis* plants were more tolerant to cold than wild-type control plants grown under similar conditions in plate-based germination assays. Two overexpressing lines were more heat tolerant than wild-type plants, and one 35S::G3649 line was found to be more desiccation tolerant than wild type.

Utilities.

G3649 or its equivalogs can be used to increase the tolerance of plants to cold conditions and low water conditions, including drought.

The G1274 Clade of Transcription Factor Polypeptides

G1274 (SEQ ID NO: 5 and 6)

G1274 is a member of the WRKY family of transcription factors. The gene corresponds to WRKY51 (At5g64810). G1274 and closely-related clade member sequences each comprise a conserved WRKY DNA-binding domain that is expected to function in a similar manner in each of these related sequences, that is, by playing a central role in transcriptional regulation and in the conferring of shared traits.

Experimental Observations.

RT-PCR analysis was used to determine the endogenous expression pattern of G1274. Expression of G1274 was detected in leaf, root and flower tissues. The biotic stress related conditions, *Erysiphe* and SA treatment, induced expression of G1274 in leaf tissue. The gene also appeared to be slightly induced by osmotic and cold stress treatments and perhaps by auxin.

The function of G1274 was studied using transgenic plants in which the gene was expressed under the control of the 35S promoter. G1274 overexpressing lines were more tolerant to growth on low nitrogen containing media. In an assay intended to determine whether the transgene expression could alter C/N sensing, 35S::G1274 seedlings contained less anthocyanins than wild-type controls (grown on high sucrose/N- and high sucrose/N/Gln plates. These data together indicated that overexpression of G1274 may alter a plant's ability to modulate carbon and/or nitrogen uptake and utilization.

G1274 overexpression and wild-type germination were also compared in a cold germination assay, the overexpressors appearing larger and greener than the controls.

35S::G1274-overexpressing plants were significantly greener and larger than wild-type control plants in a soil-based drought assay (Tables 11 and 12). These assays confirmed the results predicted after the performance of the plate-based osmotic stress assays; 35S::G1274 lines fared much better after a period of water deprivation than control plants. This distinction was particularly evident in the over-expressor plants after once again being watered; the over-expressor plants almost all fully recovered to a healthy and vigorous state. Conversely, none of the wild-type plants recovered after rewatering, as it was apparently too late for rehydration to rescue these plants (Table 12).

In addition, 35S::G1274 transgenic plants were more tolerant to chilling compared to the wild-type controls, in both germination as well as seedling growth assays.

Overexpression of G1274 produced alterations in leaf morphology and inflorescence architecture. Four out of eighteen 35S::G1274 primary transformants were slightly small and developed inflorescences that were short, and showed reduced internode elongation, leading to a bushier, more compact stature than in wild-type.

In an experiment using T2 populations, it was observed that the rosette leaves from many of the plants were distinctly broad and appeared to have a greater rosette biomass than in wild type.

A similar inflorescence phenotype was obtained from overexpression of a potentially related WRKY gene, G1275. However, G1275 also caused extreme dwarfing, which was not apparent when G1274 was overexpressed.

Utilities.

The phenotypic effects of G1274 or equivalog overexpression could have several potential applications:

The enhanced performance of 35S::G1274 plants in a soil-based drought assay indicated that the gene or its equivalogs may be used to enhance drought tolerance in plants.

The enhanced performance of 35S::G1274 seedlings under chilling conditions indicates that the gene or its equivalogs might be applied to engineer crops that show better growth under cold conditions.

The morphological phenotype shown by 35S::G1274 lines indicate that the gene or its equivalogs might be used to alter inflorescence architecture, to produce more compact dwarf forms that might afford yield benefits.

The effects on leaf size that were observed as a result of G1274 or equivalog overexpression might also have commercial applications. Increased leaf size, or an extended period of leaf growth, could increase photosynthetic capacity, and biomass, and have a positive effect on yield. G1274 equivalogs include, for example, *Arabidopsis thaliana* SEQ ID NO: 30 (G1275) and SEQ ID NO: 32 (G1758); *Oryza sativa* (*japonica* cultivar-group) SEQ ID NO: 134 (G3721), SEQ ID NO: 142 (G3725), SEQ ID NO: 144 (G3726), SEQ ID NO: 150 (G3729), and SEQ ID NO: 152 (G3730); *Glycine max* SEQ ID NO: 138 (G3723), SEQ ID NO: 140 (G3724), and SEQ ID NO: 208 (G3803); *Solanum tuberosum* SEQ ID NO: 156 (G3732); *Capsicum annuum* SEQ ID NO: 202 (G3795); *Lactuca sativa* SEQ ID NO: 204 (G3797); *Hordeum vulgare* SEQ ID NO: 158 (G3733); *Zea mays* SEQ ID NO: 130 (G3719), SEQ ID NO: 132 (G3720), SEQ ID NO: 136 (G3722), SEQ ID NO: 146 (G3727), SEQ ID NO: 148 (G3728), and SEQ ID NO: 210 (G3804); *Sorghum bicolor* SEQ ID NO: 206 (G3802); and *Lycopersicon esculentum* SEQ ID NO: 154 (G3731).

The G922 Clade of Transcription Factor Polypeptides

G922 (SEQ ID NO: 3 and 4)

G922 corresponds to Scarecrow-like 3 (SCL3) first described by Pysh et al. (GenBank accession number AF036301; (1999) *Plant J.* 18: 111-119). Northern blot analysis results show that G922 is expressed in siliques, roots, and to a lesser extent in shoot tissue from 14 day old seedlings. Pysh et al did not test any other tissues for G922 expression. In situ hybridization results showed that G922 was expressed predominantly in the endodermis in the root tissue. This pattern of expression was very similar to that of SCARECROW (SCR), G306. Experimental evidence indicated that the co-localization of the expression is not due to cross-hybridization of the G922 probe with G306. Pysh et al proposed that G922 may play a role in epidermal cell specification and that G922 may either regulate or be regulated by G306. G922 and closely-related clade member sequences each comprise at least one conserved SCR domain that is expected to function in a similar manner in each of these related sequences, that is, by playing a central role in transcriptional regulation and in the conferring of shared traits.

The sequence for G922 can also be found in the annotated BAC clone F11F12 from chromosome 1 (GenBank accession number AC012561). The sequence for F11F12 was submitted to GenBank by the DNA Sequencing and Technology Center at Stanford University.

Experimental Observations.

The function of this gene was analyzed using transgenic plants in which G922 was expressed under the control of the 35S promoter.

Morphologically, plants overexpressing G922 had altered leaf morphology, coloration, fertility, and overall plant size. In wild-type plants, expression of G922 was induced by auxin, ABA, heat, and drought treatments. In non-induced wild-type plants, G922 was expressed constitutively at low levels.

Transgenic plants overexpressing G922 were more salt tolerant than wild-type plants as determined by a root growth assay on MS media supplemented with 150 mM NaCl; 35S::G922 overexpressors exhibited greener seedlings with longer roots than wild-type seedlings.

G922 overexpressors were more cold tolerant than wild-type controls, with overexpressor lines accumulating less anthocyanin than wild-type plants.

G922 overexpressors were also more desiccation tolerant in plate-based assays than wild-type control plants, as the seedlings of the former were larger and greener in these experiments.

Almost all of the G922 overexpressors were exhibited a degree of insensitivity to ABA; on ABA-containing plates, overexpressor seedlings were larger and greener than wild-type controls. For some lines, the difference between overexpressors and wild-type plants was dramatic.

*Arabidopsis* plants overexpressing G922 also were more tolerant to osmotic stress as determined by germination assays in sucrose (9.4%)-containing media than controls; overexpressors had greener cotyledons and longer roots than wild-type seedlings on the same media.

The high salt, ABA, osmotic stress and plate-based desiccation assays suggested that this gene would confer drought tolerance, a supposition confirmed by soil-based assays, in which G922-overexpressing plants were significantly healthier after water deprivation treatment than wild-type control plants (Tables 11 and 12).

Utilities.

Based upon results observed in plants overexpressing G922 or its equivalogs could be used to alter salt tolerance, tolerance to osmotic stress, and leaf morphology in other plant species. Evaporation from the soil surface causes upward water movement and salt accumulation in the upper soil layer where the seeds are placed. Thus, germination normally takes place at a salt concentration much higher than the mean salt concentration in the whole soil profile. Increased salt tolerance during the germination stage of a crop plant would impact survivability and yield.

Altered leaf morphology conferred by overexpression of G922 or its equivalogs could be desirable in ornamental horticulture. G922 equivalogs include, for example, *Oryza sativa* (*japonica* cultivar-group) SEQ ID NO: 218 (G3814), SEQ ID NO: 216 (G3813), and SEQ ID NO: 222 (G3827); *Lycopersicon esculentum* SEQ ID NO: 220 (G3824); and *Glycine max* SEQ ID NO: 212 (G3810) and SEQ ID NO: 214 (G3811).

The G2999 Clade of Transcription Factor Polypeptides

G2999 (SEQ ID NO: 13 and 14)

G2999 was identified within a sequence released by the *Arabidopsis* Genome Initiative (Chromosome 2, GenBank accession AC006439). G2999 and closely-related clade member sequences each comprise a conserved ZF-HD protein dimerization domain and a homeo_ZF_HD homeobox domain that are expected to function in a similar manner in each of these related sequences, that is, by playing a central role in transcriptional regulation and in the conferring of shared traits.

Experimental Observations.

The boundaries of G2999 were determined by RACE experiments and a full-length clone was PCR-amplified out of cDNA derived from mixed tissues. The function of G2999 was then assessed by analysis of transgenic *Arabidopsis* lines in which the cDNA was constitutively expressed from a 35S CaMV promoter. 35S::G2999 transformants displayed wild-type morphology, but two of three T2 lines showed increased tolerance to salt stress. Root growth assays with G2999 overexpressing seedlings and controls in a high sodium chloride medium showed that a majority of 35S::G2999 *Arabidopsis* seedlings appeared larger, greener, and had more root growth than the control seedlings. G2998, a paralogous *Arabidopsis* sequence, also showed a salt tolerance phenotype in a plate-based salt stress assay, where these overexpressors were greener and had more cotyledon expansion than wild-type seedlings. Thus, G2998 and G2999 could act in the same pathways, and have a role in the response to abiotic stress.

G2999 overexpressing lines were also more osmotic stress tolerant, as evidenced by comparing their growth with wild-type plants on 9.4% sucrose, and more cold tolerant than wild-type plants.

These assays suggested that this gene would confer drought tolerance, a supposition confirmed in a soil-based assay in which G2999 overexpressing-plants were significantly more drought tolerant than wild-type control plants (Tables 11 and 12).

Utilities.

Given the pattern of abiotic stress tolerance exhibited by 35S::G2999 transformants, the gene and its equivalogs can be used to engineer drought and salt tolerant crops and trees that can flourish in conditions of osmotic stress. G2999 equivalogs include, for example, *Arabidopsis thaliana* SEQ ID NO: 50 (G2992), SEQ ID NO: 48 (G2991), SEQ ID NO: 68 (G3002), SEQ ID NO: 66 (G3001), SEQ ID NO: 46 (G2990), SEQ ID NO: 44 (G2989), SEQ ID NO: 62 (G2998), SEQ ID NO: 64 (G3000), SEQ ID NO: 54 (G2994), SEQ ID NO: 52 (G2993), SEQ ID NO: 60 (G2997), SEQ ID NO: 58 (G2996), SEQ ID NO: 56 (G2995); *Zea mays* SEQ ID NO: 114 (G3680); *Oryza sativa* (*japonica* cultivar group) SEQ ID NO: 128 (G3695), SEQ ID NO: 126 (G3694), SEQ ID NO: 122 (G3690), SEQ ID NO: 118 (G3685), SEQ ID NO: 108 (G3671), SEQ ID NO: 116 (G3683), and SEQ ID NO: 124 (G3692); *Oryza sativa* (indica cultivar group) SEQ ID NO: 120 (G3686) and SEQ ID NO: 110 (G3674); *Lotus corniculatus* var. *japonicus* SEQ ID NO: 102 (G3663) and SEQ ID NO: 106 (G3670); *Brassica napus* SEQ ID NO: 112 (G3675); and *Flaveria bidentis* SEQ ID NO: 104 (G3668).

G2989 (SEQ ID NO: 43 and 44)

G2989 is a paralog of G2999 from *Arabidopsis*. G2989 and closely-related clade member sequences each comprise a conserved ZF-HD protein dimerization domain and a homeo_ZF_HD homeobox domain that are expected to function in a similar manner in each of these related sequences, that is, by playing a central role in transcriptional regulation and in the conferring of shared traits.

Experimental Observations.

G2989 overexpressors were more desiccation and cold tolerant than wild-type controls in plate-based assays.

Utilities.

Given the pattern of abiotic stress tolerance exhibited by 35S::G2989 transformants, the gene and its equivalogs can be used to engineer drought and cold tolerant crops and trees.

G2990 (SEQ ID NO: 45 and 46)

G2990 is a paralog of G2999 from *Arabidopsis*. G2990 and closely-related clade member sequences each comprise a conserved ZF-HD protein dimerization domain and a homeo_ZF_HD homeobox domain that are expected to function in a similar manner in each of these related sequences, that is, by playing a central role in transcriptional regulation and in the conferring of shared traits.

Experimental Observations.

G2990 overexpressors were more ABA insensitive and desiccation and cold tolerant than wild-type controls in plate-based assays.

Utilities.

Given the pattern of abiotic stress tolerance exhibited by 35S::G2990 transformants, the gene and its equivalogs can be used to engineer drought and cold tolerant crops and trees.

G2992 (SEQ ID NO: 49 and 50)

G2992 corresponds to gene F24J1.29 within BAC clone F24J1 (GenBank accession AC021046) derived from chromosome 1. We identified this locus as a novel member of the ZF-HB family and no data regarding its function are currently in the public domain (as of 8/5/02). G2992 and closely-related clade member sequences each comprise a conserved ZF-HD protein dimerization domain and a homeo_ZF_HD homeobox domain that are expected to function in a similar manner in each of these related sequences, that is, by playing a central role in transcriptional regulation and in the conferring of shared traits.

Experimental Observations.

The boundaries of G2992 were determined by RACE, and a clone was PCR-amplified from cDNA derived from mixed tissue samples. The function of G2992 was then assessed by analysis of transgenic *Arabidopsis* lines in which the cDNA was constitutively expressed from a 35S CaMV promoter.

Morphological studies revealed that overexpression of G2992 can accelerate the onset of reproductive development, reduce plant size, and produce changes in leaf shape.

35S::G2992 T2 populations displayed an enhanced ability to germinate on plates containing high levels of sodium chloride. The role of G2992 in a response pathway to abiotic stress was affirmed by a soil-based drought assay, in which it was shown that G2992 overexpressors were, on average, more tolerant to water deprivation conditions in soil-based drought assays than wild-type plants (Table 12), and one of the lines tested was significantly more drought tolerant than the wild-type controls.

Utilities.

Based on the phenotypes observed in morphological and physiological assays, G2992 might have a number of applications.

Given the drought and salt tolerance exhibited by 35S::G2992 transformants, the gene and its equivalogs might be used to engineer drought and salt tolerant crops and trees that can flourish in drought conditions and salinified soils.

The early flowering exhibited by 35S::G2992 lines, indicates that the gene might be used to manipulate flowering time in commercial species. In particular, G2992 could be applied to accelerate flowering or eliminate any requirements for vernalization. In some instances, a faster cycling time might allow additional harvests of a crop to be made within a given growing season. Shortening generation times could also help speed-up breeding programs, particularly in species such as trees, which typically grow for many years before flowering. Conversely, it might be possible to modify the activity of G2992 (or its equivalogs) to delay flowering in order to achieve an increase in biomass and yield.

Finally, the effects of G2992 overexpression on leaf shape suggest that the gene might be used to modify plant architecture.

G2994 (SEQ ID NO: 53 and 54)

G2994 is a paralog of G2999 from *Arabidopsis*. G2994 and closely-related clade member sequences each comprise a conserved ZF-HD protein dimerization domain and a homeo_ZF_HD homeobox domain that are expected to function in a similar manner in each of these related sequences, that is, by playing a central role in transcriptional regulation and in the conferring of shared traits.

Experimental Observations.

Almost all of the G2994 overexpressors tested were more ABA insensitive than wild-type controls in plate-based assays.

Utilities.

Given the ABA insensitivity exhibited by 35S::G2994 transformants, the gene and its equivalogs can be used to engineer osmotic stress and drought tolerant crops and trees.

G2996 (SEQ ID NO: 57 and 58)

G2996 is a paralog of G2999 from *Arabidopsis*. G2996 and closely-related clade member sequences each comprise a conserved ZF-HD protein dimerization domain and a homeo_ZF_HD homeobox domain that are expected to function in a similar manner in each of these related sequences, that is, by playing a central role in transcriptional regulation and in the conferring of shared traits.

Experimental Observations.

Many of the G2996 overexpressors tested were larger on 9.4% sucrose than wild-type controls in plate-based assays.

Utilities.

Given the sugar sensing phenotype exhibited by 35S::G2996 transformants, the gene and its equivalogs can be used to engineer osmotic stress and drought tolerant crops and trees.

G2997 (SEQ ID NO: 59 and 60)

G2997 is a paralog of G2999 from *Arabidopsis*. G2997 and closely-related clade member sequences each comprise a conserved ZF-HD protein dimerization domain and a homeo_ZF_HD homeobox domain that are expected to function in a similar manner in each of these related sequences, that is, by playing a central role in transcriptional regulation and in the conferring of shared traits.

Experimental Observations.

Almost all of the G2997 overexpressors tested were more ABA insensitive than wild-type controls in plate-based assays.

Utilities.

Given the ABA insensitivity exhibited by 35S::G2997 transformants, the gene and its equivalogs can be used to engineer osmotic stress and drought tolerant crops and trees.

G3002 (SEQ ID NO: 67 and 68)

G3002 is a paralog of G2999 from *Arabidopsis*. Seedlings of G3002 overexpressors were generally slightly larger than wild-type controls. G3002 and closely-related clade member sequences each comprise a conserved ZF-HD protein dimerization domain and a homeo_ZF_HD homeobox domain that are expected to function in a similar manner in each of these related sequences, that is, by playing a central role in transcriptional regulation and in the conferring of shared traits.

Experimental Observations.

G3002 overexpressors were more heat and cold tolerant than wild-type controls in plate-based germination and growth assays.

Utilities.

Given the pattern of abiotic stress tolerance exhibited by 35S::G3002 transformants, the gene and its equivalogs can be used to engineer heat, drought and cold tolerant crops and trees.

The G3086 Clade of Transcription Factor Polypeptides

G3086 (SEQ ID NO: 15 and 16)

G3086 corresponds to gene AT1G51140, annotated by the *Arabidopsis* Genome Initiative. No information is available about the function(s) of G3086. G3086 and closely-related clade member sequences each comprise a conserved bHLH DNA-binding and dimerization domain that is expected to function in a similar manner in each of these related sequences, that is, by playing a central role in transcriptional regulation and in the conferring of shared traits.

Experimental Observations.

The function of G3086 was studied using transgenic plants in which the gene was expressed under the control of the 35S promoter. Overexpression of G3086 in *Arabidopsis* produced a pronounced acceleration in the onset of flowering. 35S::G3086 transformants produced visible flower buds 5-7 days early (in inductive 24-hour light conditions). Some lines were markedly smaller than wild-type controls, although a number of lines at the seedling stage were slightly larger than wild-type plants at the same stage.

G3086 overexpressing lines were larger and more tolerant of cold stress; the overexpressors were generally larger than the wild type plants when grown in cold conditions.

35S::G3086 transformants were also larger and displayed more root growth when grown under high salt conditions. G3086 overexpressors were larger, greener, and had more root growth than control plants.

Several G3086 overexpressing lines were more tolerant to desiccation in plate-based assays than wild-type control plants.

These abiotic stress assays suggested that this gene may confer drought tolerance, a supposition confirmed in a soil-based assay in which G3086 overexpressing-plants were significantly more tolerant of drought stress than control plants in soil-based drought assays (Tables 11 and 12).

Utilities.

Based on the phenotypes observed in morphological and physiological assays, G3086 and its equivalogs might have a number of utilities.

Given the salt resistance exhibited by 35S::G3086 transformants, the gene or its equivalogs might be used to engineer salt tolerant crops and trees that can flourish in saline soils, or under drought conditions.

Based on the response of 35S::G3086 lines to cold stress, the gene or its equivalogs might be used to engineer crop plants with increased tolerance to abiotic stresses such as low temperatures, and may thus improve the range available for planting of many crop species.

The early flowering displayed by 35S::G3086 transformants indicated that the gene or its equivalogs might be used to accelerate the flowering of commercial species, or to eliminate any requirements for vernalization.

G3086 equivalogs include, for example, *Arabidopsis thaliana* SEQ ID NO: 26 (G592), SEQ ID NO: 28 (G1134), SEQ ID NO: 38 (G2149), SEQ ID NO: 40 (G2555); and SEQ ID NO: 42 (G2766); *Oryza sativa* (*japonica* cultivar-group) SEQ ID NO: 168 (G3740), SEQ ID NO: 170 (G3741), SEQ ID NO: 172 (G3742), SEQ ID NO: 174 (G3744), and SEQ ID NO: 176 (G3746); *Glycine max* SEQ ID NO: 180 (G3763), SEQ ID NO: 182 (G3764), SEQ ID NO: 184 (G3765), SEQ ID NO: 186 (G3766), SEQ ID NO: 188 (G3767), SEQ ID NO: 190 (G3768), SEQ ID NO: 192 (G3769), SEQ ID NO: 194 (G3771), and SEQ ID NO: 196 (G3772); *Zea mays* SEQ ID NO: 178 (G3755); and *Pinus taeda* SEQ ID NO: 197 (G3782).

The G354 Clade of Transcription Factor Polypeptides

G354 (SEQ ID NO: 227 and 228)

G354 was identified in the sequence of BAC clone F12M12, GenBank accession number AL355775, released by the *Arabidopsis* Genome Initiative. G354 corresponds to ZAT7 (Meissner and Michael (1997) *Plant Mol. Biol.* 33: 615-624). G354 and closely-related clade member sequences each comprise a conserved C2H2 zinc finger DNA-binding domain that is expected to function in a similar manner in each of these related sequences, that is, by playing a central role in transcriptional regulation and in the conferring of shared traits.

Experimental Observations.

The highest level of expression of G354 was observed in rosette leaves, embryos, and siliques. Some expression of G354 was also observed in flowers.

The function of this gene was analyzed using transgenic plants in which G353 was expressed under the control of the 35S promoter. 35S::G354 plants had a reduction in flower pedicel length, and downward pointing siliques. This phenotype was very similar to that described for the brevipedicellus (bp) mutant (Koornneef et al. (1983) *J. Hered.* 74: 265-272) and in overexpression of a related gene G353. Other morphological changes in shoots were also observed in 35S::G354 plants. Many 35S::G354 seedlings had abnormal cotyledons, elongated, thickened hypocotyls, and short roots. The majority of T1 plants had a very extreme phenotype, were tiny, and arrested development without forming inflorescences. T1 plants showing more moderate effects had poor seed yield.

Overexpression of G354 in *Arabidopsis* resulted in seedlings with an altered response to light. In a germination assay conducted in darkness, G354 seedlings failed to show an etiolation response. In some cases the phenotype was severe; overexpression of the transgene resulted in reduced open and greenish cotyledons.

G354 overexpressors were also shown to be tolerant to water deprivation in soil-based drought assays (Tables 11 and 12). Closely related paralogs of this gene, G353 and G2839, also showed an osmotic stress tolerance phenotype in a germination assay on media containing high sucrose; one line of 35S::G353 seedlings and several lines of 35S::G2839 were greener and had higher germination rates than controls. Thus, G354 and its paralogs G353 and G2839 appear to influence osmotic stress responses.

Utilities.

G354 and its equivalogs can be could be used to increase a plant's tolerance to drought and other osmotic stress, and can be used alter inflorescence structure, which may have value in production of novel ornamental plants.

G353 (SEQ ID NO: 259 and 260)

G353 is a paralog of G354 from *Arabidopsis*. G353 and closely-related clade member sequences each comprise a conserved C2H2 DNA-binding zinc finger domain that is expected to function in a similar manner in each of these related sequences, that is, by playing a central role in transcriptional regulation and in the conferring of shared traits.

Experimental Observations.

Overexpressors of G353 have shown an osmotic stress tolerance phenotype in a germination assay on media containing high sucrose. These results suggested that the gene may also confer drought tolerance, an indication confirmed in soil-based drought assays. In the latter assays, G353 overexpressing *Arabidopsis* plants were more tolerant to initial water deprivation, and after rewatering, exhibited superior recovery than wild-type controls.

Utilities.

G353 and its equivalogs can be could be used to increase a plant's tolerance to drought and other osmotic stress.

G2839 (SEQ ID NO: 249 and 250)

G2839 is a paralog of G354 from *Arabidopsis*. G2839 and closely-related clade member sequences each comprise a conserved C2H2 DNA-binding zinc finger domain that is expected to function in a similar manner in each of these related sequences, that is, by playing a central role in transcriptional regulation and in the conferring of shared traits.

G2839 (At3g46080) was identified in the sequence of BAC F12M12 (GenBank accession number AL355775) based on its sequence similarity within the conserved domain to other C2H2 related proteins in *Arabidopsis*. There is no published or public information about the function of G2839.

Experimental Observations.

The function of G2839 was studied using transgenic plants in which the gene was expressed under the control of the 35S promoter. Few primary transformants were generated, suggesting that G2839 overexpression can be lethal. T1 lines displayed stunted growth and development, and yielded very few or zero seeds. Inflorescences were poorly developed. In one line, flower pedicels were very short and flowers and siliques were oriented downwards. G2839 overexpressors showed a phenotype in a germination assay on media containing high sucrose: seedlings were green and had high germination rates. Thus, the gene appeared to influence sugar sensing and/or osmotic stress responses.

G2839 is similar to two other *Arabidopsis* sequences, G354 and G353. Flower phenotypes in which pedicels were very short and flowers and siliques were oriented downwards have been described for G353 and G354 and are also similar to the brevipedicellus mutant (Koornneef et al. (1983) *J. Hered.* 74: 265-272; Venglat et al. (2002) *Proc. Natl. Acad. Sci. USA.* 99:4730-4735; Douglas et al. (2002) *Plant Cell.* 14:547-558. Interestingly 35S::G353 lines also showed increased resistance to osmotic stress.

Supplementing the results of the high sucrose germination assay, G2839 was shown to be more tolerant to water deprivation than wild-type control plants in soil-based drought assays (Tables 11 and 12).

Utilities.

The phenotypes observed in physiology assays indicate that G2839 might be used to generate crop plants with altered sugar sensing. Since the gene appears to be associated with the response to osmotic stress, the gene could be used to engineer cold and dehydration tolerance. The latter was confirmed by the soil-based drought assay.

The morphological phenotype shown by 35S::G2839 lines indicate that the gene might be used to alter inflorescence architecture. In particular, a reduction in pedicel length and a change in the position at which flowers and fruits are held, might influence harvesting or pollination efficiency. Additionally, such changes might produce attractive novel forms for the ornamental markets.

The G1792 Clade of Transcription Factor Polypeptides
G1792 (SEQ ID NO: 7 and 8)

G1792 was identified in the sequence of BAC clone K14B15 (AB025608, gene K14B15.14). G1792 and closely-related clade member sequences each comprise a conserved AP2 DNA-binding domain that is expected to function in a similar manner in each of these related sequences, that is, by playing a central role in transcriptional regulation and in the conferring of shared traits.

Experimental Observations.

G1792 was studied using transgenic plants in which the gene was expressed under the control of the 35S promoter.

In soil-based assays, G1792 overexpressing plants were significantly more drought tolerant than wild-type control plants; 35S::G1792 lines fared much better after a period of water deprivation than control plants. This distinction was particularly evident in the overexpressor plants when the drought period was followed by rewatering; the overexpressor plants recovered to a healthy and vigorous state. Conversely, none of the wild-type plants in these experiments recovered after rewatering 35S::G1792 plants were more tolerant to the fungal pathogens *Fusarium oxysporum* and *Botrytis cinerea* and showed fewer symptoms after inoculation with a low dose of each pathogen. This result was confirmed using individual T2 lines. The effect of G1792 overexpression in increasing tolerance to pathogens received further, incidental confirmation. T2 plants of two 35S::G1792 lines had been growing in a room that suffered a serious powdery mildew infection. For each line, a pot of six plants was present in a flat containing nine other pots of lines from unrelated genes.

In either of the two different flats, the only plants that were free from infection were those from the 35S::G1792 line. This observation suggested that G1792 overexpression might be used to increase resistance to powdery mildew. Additional experiments confirmed that 35S::G1792 plants showed increased tolerance to *Erysiphe*. G1792 was ubiquitously expressed, but appeared to be induced by salicylic acid.

35S::G1792 overexpressing plants also showed more tolerance to growth under nitrogen-limiting conditions. In a root growth assay under conditions of limiting N, 35S::G1792 lines were slightly less stunted. The lack of anthocyanin production by 35S::G1274 seedlings grown on low nitrogen media supplemented with sucrose plus glutamine, as compared to wild-type seedlings which accumulated significant anthocyanin, indicated that these lines were less stressed than control seedlings under the same conditions. These results indicate that G1792 can be involved in monitoring carbon and nitrogen status in plants.

G1792 overexpressors and wild-type plants were also compared in a cold germination assay, in which the overexpressors were found to be generally larger and greener than the controls.

G1792 overexpressing plants showed several mild morphological alterations: leaves were dark green and shiny, and plants bolted, subsequently senesced, slightly later than wild-type controls. Among the T1 plants, additional morphological variation (not reproduced later in the T2 plants) was observed: many showed reductions in size as well as aberrations in leaf shape, phyllotaxy, and flower development.

Utilities.

G1792 or its equivalogs can be used to improve drought and other osmotic stress tolerances, and engineer pathogen-resistant plants. In addition, it can also be used to improve seedling germination and performance under conditions of limited nitrogen.

Potential utilities of this gene or its equivalogs also include increasing chlorophyll content allowing more growth and productivity in conditions of low light. With a potentially higher photosynthetic rate, fruits could have higher sugar content. Increased carotenoid content could be used as a nutraceutical to produce foods with greater antioxidant capability.

G1792 or its equivalogs could be used to manipulate wax composition, amount, or distribution, which in turn could modify plant tolerance to drought and/or low humidity or resistance to insects, as well as plant appearance (shiny leaves). Increased wax deposition on leaves of a plant like cotton may improve drought resistance or water use efficiency. A possible application for this gene might be in reducing the wax coating on sunflower seeds (the wax fouls the oil extraction system during sunflower seed processing for oil). For this purpose, antisense or co-suppression of the gene in a tissue-specific manner might be useful G1792 equivalogs include, for example, *Arabidopsis thaliana* SEQ ID NO: 18 (G30), SEQ ID NO: 34 (G1791), and SEQ ID NO: 36 (G1795); *Medicago truncatula* SEQ ID NO: 160 (G3735); *Glycine max* SEQ ID NO: 82 (G3518), SEQ ID NO: 84 (G3519), SEQ ID NO: 86 (G3520); *Oryza sativa* (japonica cultivar-group) SEQ ID NO: 70 (G3380), SEQ ID NO: 72 (G3381), SEQ ID NO: 74 (G3383), SEQ ID NO: 76 (G3515), and SEQ ID NO: 164 (G3737); *Zea mays*), SEQ ID NO: 78 (G3516), SEQ ID NO: 80 (G3517), SEQ ID NO: 200 (G3794), SEQ ID NO: 166 (G3739) and *Triticum aestivum* SEQ ID NO: 162 (G3736).

G3381 (SEQ ID NO: 71 and 72)

G3381 is a rice ortholog of G1792. G3381 and closely-related clade member sequences each comprise a conserved AP2 DNA-binding domain that is expected to function in a similar manner in each of these related sequences, that is, by playing a central role in transcriptional regulation and in the conferring of shared traits.

Experimental Observations.

In plate-based assays, G3381 overexpressors were more tolerant to mannitol and cold conditions than wild-type controls.

Utilities.

G3381 and its equivalogs may be used to confer osmotic stress, drought and cold tolerance in plants.

G3383 (SEQ ID NO: 73 and 74)

G3383 is a rice ortholog of G1792. G3383 and closely-related clade member sequences each comprise a conserved AP2 DNA-binding domain that is expected to function in a similar manner in each of these related sequences, that is, by playing a central role in transcriptional regulation and in the conferring of shared traits.

Experimental Observations.

In plate-based assays, G3383 overexpressors were more tolerant to mannitol, cold and desiccation conditions than wild-type controls.

Utilities.

G3383 and its equivalogs may be used to confer osmotic stress, drought and cold tolerance in plants.

G3517 (SEQ ID NO: 73 and 74)

G3517 is a corn ortholog of G1792. G3517 and closely-related clade member sequences each comprise a conserved AP2 DNA-binding domain that is expected to function in a similar manner in each of these related sequences, that is, by playing a central role in transcriptional regulation and in the conferring of shared traits.

Experimental Observations.

In plate-based assays, G3517 overexpressors were more tolerant to heat, cold and desiccation conditions than wild-type controls.

Utilities.

G3517 and its equivalogs may be used to confer heat stress, osmotic stress, drought and cold tolerance in plants.

The G2053 Clade of Transcription Factor Polypeptides

G2053 (SEQ ID NO: 9 and 10)

G2053 was identified in the sequence of BAC T27C4, GenBank accession number AC022287, released by the *Arabidopsis* Genome Initiative. G2053 and closely-related clade member sequences each comprise a conserved NAC DNA-binding and dimerization domain that is expected to function in a similar manner in each of these related sequences, that is, by playing a central role in transcriptional regulation and in the conferring of shared traits.

Experimental Observations.

The function of G2053 was analyzed using transgenic plants in which the gene was expressed under the control of the 35S promoter. Overexpression of G2053 in *Arabidopsis* resulted in plants with altered osmotic stress tolerance. In a root growth assay on media containing high concentrations of PEG, G2053 overexpressors showed more root growth and were generally larger than wild-type controls.

The osmotic stress tolerance assays suggested that this gene may confer drought tolerance, a supposition confirmed in soil-based assays in which G2053 overexpressors were significantly more drought tolerant than wild-type control plants (Tables 11 and 12).

Utilities.

Based on the altered stress tolerance induced by G2053 overexpression, this transcription factor or its equivalogs could be used to alter a plant's response water deficit conditions and, therefore, could be used to engineer plants with enhanced tolerance to drought, salt stress, and freezing.

G2053 equivalogs include, for example, *Arabidopsis thaliana* SEQ ID NO: 20 (G515), SEQ ID NO: 22 (G516), and SEQ ID NO: 24 (G517)

G516 (SEQ ID NO: 21 and 22)

G516 is a paralog of G2053 from *Arabidopsis*. G516 and closely-related clade member sequences each comprise a conserved NAC DNA-binding and dimerization domain that is expected to function in a similar manner in each of these related sequences, that is, by playing a central role in transcriptional regulation and in the conferring of shared traits.

Experimental Observations.

35S::G516 overexpressors were more tolerant to mannitol and cold than wild-type control plants.

Utilities.

Based on the abiotic assay stress results, G516 could be used to engineer plants with enhanced tolerance to osmotic stress, drought and cold.

The G975 Clade of Transcription Factor Polypeptides

G975 (SEQ ID NO: 237 and 238)

After its discovery by us, G975 has appeared in the sequences released by the *Arabidopsis* Genome Initiative (BAC F9L1, GenBank accession number AC007591). G975 and closely-related clade member sequences each comprise a conserved AP2 DNA binding domain that is expected to function in a similar manner in each of these related sequences, that is, by playing a central role in transcriptional regulation and in the conferring of shared traits. G975 and closely-related clade member sequences each comprise a conserved AP2 DNA-binding domain that is expected to function in a similar manner in each of these related sequences, that is, by playing a central role in transcriptional regulation and in the conferring of shared traits.

Experimental Observations.

G975 was discovered by us and is a new member of the AP2/EREBP family (EREBP subfamily) of transcription factors. G975 is expressed in flowers and, at lower levels, in shoots, leaves, and siliques. GC-FID and GC-MS analyses of leaves from G975 overexpressing plants have shown that the levels of C29, C31, and C33 alkanes were substantially increased (up to 10-fold) compared to control plants. A number of additional compounds of similar molecular weight, presumably also wax components, also accumulated to significantly higher levels in G975 overexpressing plants. Although total amounts of wax in G975 overexpressing plants have not yet been measured, C29 alkanes constitute close to 50% of the wax content in wild-type plants (Millar et al. (1998) *Plant Cell* 11: 1889-1902), indicating that a major increase in total wax content occurs in these transgenic plants. However, the transgenic plants had an almost normal phenotype (small morphological differences are detected in leaf appearance), indicating that overexpression of G975 is not deleterious to the plant. It is noteworthy that overexpression of G975 did not cause the dramatic alterations in plant morphology that have been reported for *Arabidopsis* plants in which the FATTY ACID ELONGATION1 gene was overexpressed (Millar et al. (1998) supra). G975 could specifically regulate the expression of some of the genes involved in wax metabolism. One *Arabidopsis* AP2 gene was found that is significantly more closely related to G975 than the rest of the members of the AP2/EREBP family. This other gene, G1387, may have a function, and therefore a utility, related to that of G975.

Plants overexpressing G975 were significantly larger and greener than wild-type control plants in a soil-based drought assay (Tables 11 and 12).

Utilities.

G975 or its equivalogs could be used to improve a plant's tolerance to drought or low water conditions.

G975 or its equivalogs could be used to manipulate wax composition, amount, or distribution, which in turn could modify plant tolerance to drought and/or low humidity or resistance to insects, as well as plant appearance (shiny leaves). A possible application for this gene or its equivalogs might be in reducing the wax coating on sunflower seeds (the wax fouls the oil extraction system during sunflower seed processing for oil). For this purpose, antisense or co-suppression of the gene in a tissue-specific manner might be useful.

G975 could also be used to specifically alter wax composition, amount, or distribution in those plants and crops from which wax is a valuable product.

The G1073 Clade of Transcription Factor Polypeptides

G1073 (SEQ ID NO: 239 and 240), AtHRC1

G1073 has been identified in the sequence of a BAC clone from chromosome 4 (BAC clone F23E12, gene F23E12.50, GenBank accession number AL022604), released by EU *Arabidopsis* Sequencing Project. G1073 and closely-related clade member sequences each comprise a conserved At-hook domain and a second conserved domain (amino acids 43-187) or the DUF296 domain (amino acids 61-180) that are expected to function in a similar manner in each of these related sequences, that is, by playing a central role in transcriptional regulation and in the conferring of shared traits.

Experimental Observations.

The function of G1073 was analyzed using transgenic plants in which G1073 was expressed under the control of the cauliflower mosaic virus 35S promoter (these transgenic plants are referred to as "35S::G1073"). Transgenic plants overexpressing G1073 were substantially larger than wild-type controls, with at least a 60% increase in biomass (Table 10). The increased mass of 35S::G1073 transgenic plants was attributed to enlargement of multiple organ types including stems, roots and floral organs; other than the size differences, these organs were not affected in their overall morphology. 35S::G1073 plants exhibited an increase of the width (but not length) of mature leaf organs, produced 2-3 more rosette leaves, and had enlarged cauline leaves in comparison to corresponding wild-type leaves. Overexpression of G1073 resulted in an increase in both leaf mass and leaf area per plant, and leaf morphology (G1073 overexpressors tended to produce more serrated leaves). We also found that root mass was increased in the transgenic plants, and that floral organs were also enlarged. An increase of approximately 40% in stem diameter was observed in the transgenic plants. Images from the stem cross-sections of 35S::G1073 plants revealed that cortical cells are large and that vascular bundles contained more cells in the phloem and xylem relative to wild type. Petal size in the 35S::G1073 lines was increased by 40-50% compared to wild type controls. Petal epidermal cells in those same lines were approximately 25-30% larger than those of the control plants. Furthermore, 15-20% more epidermal cells per petal were produced compared to wild type. Thus, in petals and stems, the increase in size was associated with an increase in cell size as well as in cell number.

Seed yield was also increased compared to control plants. 35S::G1073 lines showed an increase of at least 70% in seed yield (Table 10). This increased seed production was associated with an increased number of siliques per plant, rather than seeds per silique.

TABLE 10

Comparison of biomass and seed yield production in *Arabidopsis* wild-type and two 35S::G1073 overexpressing lines

| Line | Fresh Weight (g) | Dry Weight (g) | Seed (g) |
| --- | --- | --- | --- |
| Wild-type | 3.43 ± 0.70 | 0.73 ± 0.20 | 0.17 ± 0.07 |
| 35S::G1073-3 | 5.74 ± 1.74 | 1.17 ± 0.30 | 0.31 ± 0.08 |
| 35S::G1073-4 | 6.54 ± 2.19 | 1.38 ± 0.44 | 0.35 ± 0.12 |

All 35S::G1073 lines tested (10/10) exhibited significantly improved salt tolerance. Most of these lines also showed a sugar sensing phenotype, exhibiting improved germination on high sucrose media. One line showed increased heat germination tolerance. Flowering of G1073 overexpressing plants was delayed. Leaves of G1073 overexpressing plants were generally more serrated than those of wild-type plants. Improved drought tolerance was observed in 35S::G1073 transgenic lines.

A number of the CUT1::G1073 lines tested exhibited significantly improved salt tolerance and sugar sensing on high sucrose. One line showed improved germination on high mannitol.

Half of the ARSK::G1073 lines tested (5/10) showed improved germination on high salt, and two lines showed improved germination in cold relative to controls.

Utilities.

Large size and late flowering produced as a result of G1073 or equivalog overexpression would be extremely useful in crops where the vegetative portion of the plant is the marketable portion (often vegetative growth stops when plants make the transition to flowering). In this case, it would be advantageous to prevent or delay flowering with the use of this gene or its equivalogs in order to increase yield (biomass). Prevention of flowering by this gene or its equivalogs would be useful in these same crops in order to prevent the spread of transgenic pollen and/or to prevent seed set. This gene or its equivalogs could also be used to manipulate leaf shape, abiotic stress tolerance, including drought and salt tolerance, and seed yield.

G1069 (SEQ ID NO: 239 and 240)

G1069 is a sequence functionally and structurally related to G1073 from *Arabidopsis*. G1069 and closely-related clade member sequences each comprise a conserved At-hook domain and a second conserved domain (amino acids 76-218) or the DUF296 domain (amino acids 93-211) that are expected to function in a similar manner in each of these related sequences, that is, by playing a central role in transcriptional regulation and in the conferring of shared traits.

The sequence of G1069 was obtained from EU *Arabidopsis* sequencing project, GenBank accession number Z97336, based on its sequence similarity within the conserved domain to other AT-Hook related proteins in *Arabidopsis*.

Experimental Observations.

The sequence of G1069 was experimentally determined and the function of G1069 was analyzed using transgenic plants in which G1069 was expressed under the control of the 35S promoter.

Plants overexpressing G1069 showed changes in leaf architecture, reduced overall plant size, and retarded progression through the life cycle. This is a common phenomenon for most transgenic plants in which AT-HOOK proteins are overexpressed if the gene is predominantly expressed in root in the wild-type background. G1069 was predominantly expressed in roots, based on analysis of RT-PCR results. To minimize these detrimental effects, G1069 may be overexpressed under a tissue-specific promoter such as root- or leaf-specific promoter or under inducible promoter.

One of G1069 overexpressing lines showed more tolerance to osmotic stress when they were germinated in high sucrose plates. This line also showed insensitivity to ABA in a germination assay.

The high sucrose and ABA assay results suggested that this gene may confer increased tolerance to other abiotic stresses when G1069 is overexpressed. This was subsequently confirmed in soil-based drought assays in which 35S::G1069 plants were more drought tolerant than wild-type control plants (Tables 11 and 12).

Utilities.

The drought and osmotic stress results indicate that G1069 could be used to alter a plant's response to water deficit conditions and, therefore, the gene or its equivalogs could be used to engineer plants with enhanced tolerance to drought, salt stress, and freezing.

G1069 affects ABA sensitivity, and thus when transformed into a plant the gene or its equivalogs may diminish cold, drought, oxidative and other stress sensitivities, and also be used to alter plant architecture, and yield.

G2789 (SEQ ID NO: 247 and 248)

G2789 is a sequence functionally and structurally related to G1073 from *Arabidopsis*. G2789 and closely-related clade member sequences each comprise a conserved At-hook domain and a second conserved domain (amino acids 68-208) or the DUF296 domain (amino acids 86-201) that are expected to function in a similar manner in each of these related sequences, that is, by playing a central role in transcriptional regulation and in the conferring of shared traits.

The sequence of G2789 was obtained from *Arabidopsis* genomic sequencing project, GenBank accession number AL162295, based on its sequence similarity within the conserved domain to other AT-hook related proteins in *Arabidopsis*. G2789 corresponds to gene T4C21_280 (CAB82691). To date, there is no published information regarding the functions of this gene.

Experimental Observations.

The complete sequence of G2789 was determined. G2789 is expressed at moderate levels in roots, flowers, embryos, siliques, and germinating seeds. It was not detectable in rosette leaves or shoots. No significant induction of G2789 was observed in rosette leaves by any condition tested.

The function of this gene was analyzed using transgenic plants in which G2789 was expressed under the control of the 35S promoter. Overexpression of G2789 in *Arabidopsis* resulted in seedlings that are ABA insensitive and osmotic stress tolerant. In a germination assay on ABA containing media, G2789 transgenic seedlings showed enhanced seedling vigor. In a similar germination assay on media containing high concentrations of sucrose, the G2789 overexpressors also showed enhanced seedling vigor. In a repeat experiment on individual lines, all three lines show the phenotype. The combination of ABA insensitivity and better germination under osmotic stress was also observed for G1820. It is possible that ABA insensitivity at the germination stage promotes germination despite unfavorable conditions.

The osmotic stress tolerance and enhanced seedling vigor on ABA phenotypes suggested that G2789 overexpressors would be more tolerant to drought conditions This supposition was confirmed by soil-based drought assays, in which plants overexpressing G2789 performed significantly better in conditions of water deprivation than wild-type plants (Tables 11 and 12).

Utilities.

G2789 could be used to alter a plant's response to water deficit conditions and therefore, could be used to engineer plants with enhanced tolerance to drought, salt stress, and freezing.

Rice G3399 (SEQ ID NO: 339 and 340)

G3399 is a rice ortholog of G1073. Phylogenetic analysis identifies G3399 along with G3400 as being the most closely related rice orthologs of G1073. G3399 and closely-related clade member sequences each comprise a conserved At-hook domain and a second conserved domain (amino acids 108-253) or the DUF296 domain (amino acids 126-246) that are expected to function in a similar manner in each of these related sequences, that is, by playing a central role in transcriptional regulation and in the conferring of shared traits.

The morphologically similar effects caused by overexpression of this rice gene versus G1073 and other *Arabidopsis* paralogs suggest that they likely have related functions. A number of *Arabidopsis* lines overexpressing G3399 and G3407 under the control of the 35S promoter were found be larger, with broader leaves and larger rosettes than wild-type control plants. Two of the lines overexpressing G3399 were found to have greater tolerance to desiccation and heat than wild-type controls in plate-based assays, and drought in soil-based assays.

Utilities.

G3399 could be used to increase a plant's biomass and alter a plant's response to cold and water deficit conditions and, therefore, could be used to engineer plants with enhanced tolerance to drought.

Rice G3407 (SEQ ID NO: 353 and 354)

G3407 is a rice ortholog of G1073. G3407 and closely-related clade member sequences each comprise a conserved At-hook domain and a second conserved domain (amino acids 72-220) or the DUF296 domain (amino acids 90-213) that are expected to function in a similar manner in each of these related sequences, that is, by playing a central role in transcriptional regulation and in the conferring of shared traits.

The morphologically similar effects caused by overexpression of this rice gene versus G1073 and other *Arabidopsis* paralogs suggest that they likely have related functions.

Experimental Observations.

At the seedling stage, about half of the 35S::G3407 lines appeared larger than controls. At later stages of growth, lines overexpressing G3407 showed no consistent morphological differences from control plants, with the exception of one line which was 50% larger than controls at the rosette stage.

Two lines of overexpressors were less sensitive germination in cold conditions than wild type controls.

Utilities.

G3407 could be used to increase a plant's biomass and engineer plants with enhanced tolerance to cold.

Soybean G3456 (SEQ ID NO: 383 and 384)

G3456 is a sequence functionally and structurally related to G1073 from *Arabidopsis*. G3456 and closely-related clade member sequences each comprise a conserved At-hook domain and a second conserved domain (amino acids 53-195) or the DUF296 domain (amino acids 71-188) that are expected to function in a similar manner in each of these related sequences, that is, by playing a central role in transcriptional regulation and in the conferring of shared traits.

Experimental Observations.

A significant number of *Arabidopsis* lines overexpressing G3456 under the control of the 35S promoter were found be larger, with broader leaves and larger rosettes than wild-type control plants.

Most of the lines overexpressing G3456 were significantly more cold tolerant than wild-type controls. Several 35S::G3456 lines were found to have greater salt tolerance than wild type controls. Several lines of overexpressors were much more tolerant to drought than wild-type controls in soil-based assays.

Utilities.

G3456 can be used to increase a plant's biomass. G3456 may be also used to alter a plant's response to water deficit conditions and, therefore, could be used to engineer plants with enhanced tolerance to drought and salt stress.

Soybean G3459 (SEQ ID NO: 387 and 388)

G3459 is a sequence functionally and structurally related to G1073 from *Arabidopsis*. G3459 and closely-related clade member sequences each comprise a conserved At-hook domain and a second conserved domain (amino acids 86-228) or the DUF296 domain (amino acids 104-221) that are expected to function in a similar manner in each of these related sequences, that is, by playing a central role in transcriptional regulation and in the conferring of shared traits.

Experimental Observations.

A significant number of *Arabidopsis* lines overexpressing G3459 under the control of the 35S promoter were found be larger, with broader leaves and larger rosettes than wild-type control plants.

Most of the lines overexpressing G3459 conferred tolerance to one abiotic stress, and were significantly more salt, heat or cold tolerant than wild-type controls.

Utilities.

G3459 can be used to increase a plant's biomass. G3459 may be also used to alter a plant's response to water deficit conditions and, therefore, could be used to engineer plants with enhanced tolerance to salt, heat, cold and drought.

Soybean G3460 (SEQ ID NO: 389 and 390)

G3460 is a sequence functionally and structurally related to G1073 from *Arabidopsis*. G3460 and closely-related clade member sequences each comprise a conserved At-hook domain and a second conserved domain (amino acids 83-225) or the DUF296 domain (amino acids 101-218) that are expected to function in a similar manner in each of these related sequences, that is, by playing a central role in transcriptional regulation and in the conferring of shared traits.

Experimental Observations.

A significant number of *Arabidopsis* lines overexpressing G3460 under the control of the 35S promoter were found be larger, with broader leaves and larger rosettes than wild-type control plants.

Most of the lines overexpressing G3459 conferred tolerance to one abiotic stress, and were significantly more heat, desiccation or cold tolerant than wild-type controls. Several lines of overexpressors were much more tolerant to drought than wild-type controls in soil-based assays.

Utilities.

G3460 can be used to increase a plant's biomass.

G3460 may be also used to alter a plant's response to water deficit conditions and, therefore, could be used to engineer plants with enhanced tolerance to heat, drought, and cold.

The G482 Clade of Transcription Factor Polypeptides

G481 (Polynucleotide SEQ ID NO: 287 and 288)

G481 is equivalent to AtHAP3a which was identified by Edwards et al., ((1998) Plant Physiol. 117: 1015-1022) as an EST with extensive sequence homology to the yeast HAP3. G481 is a member of the HAP3 subgroup of the CCAAT box-binding transcription factor family. G481 and closely-related clade member sequences each a conserved CCAAT box-binding domain that is expected to function in a similar manner in each of these related sequences, that is, by playing a central role in transcriptional regulation and in the conferring of shared traits.

Experimental Observations.

Northern blot data from five different tissue samples indicates that G481 is primarily expressed in flower and/or silique, and root tissue. The function of G481 was analyzed through its ectopic overexpression in plants. Except for darker color in one line (noted below), plants overexpressing G481 had a wild-type morphology. G481 overexpressors were found to be more tolerant to high sucrose and high salt, having better germination, longer radicles, and more cotyledon expansion. There was a consistent difference in the hypocotyl and root elongation in the overexpressor compared to wild-type controls. These results indicated that G481 is involved in sucrose-specific sugar sensing. Sucrose-sensing has been implicated in the regulation of source-sink relationships in plants.

In the T2 generation, one overexpressing line was darker green than wild-type plants, which may indicate a higher photosynthetic rate that would be consistent with the role of G481 in sugar sensing.

35S::G481 plants were also significantly larger and greener in a soil-based drought assay than wild-type controls plants After eight days of drought treatment overexpressing lines had a darker green and less withered appearance than those in the control group. The differences in appearance between the control and G481-overexpressing plants after they were rewatered was even more striking. Eleven of twelve plants of this set of control plants died after rewatering, indicating the inability to recover following severe water deprivation, whereas all nine of the overexpressor plants of the line shown recovered from this drought treatment. These results were typical of a number of control and 35S::G481-overexpressing lines.

One line of plants in which G481 was overexpressed under the control of the ARSK1 root-specific promoter was found to germinate better under cold conditions than wild-type plants.

Interestingly, in one Arabidopsis line in which G481 was knocked out, the plants were found to be more sensitive to high salt in a plate-based assay than wild-type plants, which indicates the importance of the role played by G481 in regulating osmotic stress tolerance, and demonstrates that the gene is both necessary and sufficient to fulfill that function.

A number of the 35S::G481 plants evaluated had a late flowering phenotype.

Utilities.

The potential utility of G481 includes altering photosynthetic rate, which could also impact yield in vegetative tissues as well as seed. Sugars are key regulatory molecules that affect diverse processes in higher plants including germination, growth, flowering, senescence, sugar metabolism and photosynthesis. Sucrose is the major transport form of photosynthate and its flux through cells has been shown to affect gene expression and alter storage compound accumulation in seeds (source-sink relationships).

Since G481 overexpressing plants performed better than controls in drought experiments, this gene or its equivalogs may be used to improve seedling vigor, plant survival, as well as yield, quality, and range.

G482 (Polynucleotide SEQ ID NO: 289 and 290)

G482, a paralog of G481, is equivalent to AtHAP3b which was identified by Edwards et al. (1998) Plant Physiol. 117: 1015-1022) as an EST with homology to the yeast gene HAP3b. Their northern blot data suggests that AtHAP3b is expressed primarily in roots. G482 is a member of the HAP3 subgroup of the CCAAT box-binding transcription factor family. G482 and closely-related clade member sequences each a conserved CCAAT box-binding domain that is expected to function in a similar manner in each of these related sequences, that is, by playing a central role in transcriptional regulation and in the conferring of shared traits.

Experimental Observations.

RT-PCR analysis of endogenous levels of G482 transcripts indicated that this gene is expressed constitutively in all tissues tested. A cDNA array experiment supports the RT-PCR derived tissue distribution data. G482 is not induced above basal levels in response to any environmental stress treatments tested.

A T-DNA insertion mutant for G482 was analyzed and was found to flower slightly later than control plants.

The function of G482 was also analyzed through its ectopic overexpression in plants. Plants overexpressing G482 had a wild-type morphology. Germination assays to measure salt tolerance demonstrated increased seedling growth when germinated on the high salt medium.

35S::G482 transgenic plants also displayed an osmotic stress response phenotype similar to 35S::G481 transgenic lines. Five of ten overexpressing lines had increased seedling growth on medium containing 80% MS plus vitamins with 300 mM mannitol.

Three of ten 35S::G482 lines also demonstrated enhanced germination relative to controls after a 6 hour exposure to 32° C.

The majority of these 35S::G482 lines also demonstrated a slightly early flowering phenotype.

Utilities.

The potential utilities of this gene include the ability to confer osmotic stress tolerance, as measured by salt, heat tolerance and improved germination in mannitol-containing media, during the germination stage of a crop plant. This would most likely impact survivability and yield. Evaporation of water from the soil surface causes upward water movement and salt accumulation in the upper soil layer, where the seeds are placed. Thus, germination normally takes place at a salt concentration much higher than the mean salt concentration in the whole soil profile.

Improved osmotic stress tolerance is also likely to result in enhanced seedling vigor, plant survival, improved yield, quality, and range. Osmotic stress assays, including subjecting plants to aqueous dissolved sugars, are often used as surrogate assays for improved water-stress (for example, drought) response. Thus, G482 may also be used to improve plant performance under conditions of water deprivation, including increased seedling vigor, plant survival, yield, quality, and range.

Rice G3395 (SEQ ID NO: 331 and 332)

G3395 (rice) is an ortholog of G481 and G482, and is a member of the HAP3-like subfamily of CCAAT-box binding transcription factors. G3395 corresponds to polypeptide BAC76331 ("NF-YB subunit of rice"). G3395 and closely-related clade member sequences each a conserved CCAAT box-binding domain that is expected to function in a similar manner in each of these related sequences, that is, by playing a central role in transcriptional regulation and in the conferring of shared traits.

Experimental Observations.

The function of G3395 was analyzed through its ectopic overexpression in plants. One of the lines of 35S::G3395 overexpressors tested was found to be more tolerant to high salt levels, producing larger and greener seedlings in a high salt germination assay. Several lines were also significantly more drought tolerant than wild type controls in soil-based assays.

Utilities.

The potential utilities of G3395 include the ability to confer salt and drought stress tolerance Soy G3470 (SEQ ID NO: 393 and 394)

G3470 (soybean) is an ortholog of G481 and G482, and is a member of the HAP3-like subfamily of CCAAT-box binding transcription factors. G3470 and closely-related clade member sequences each a conserved CCAAT box-binding domain that is expected to function in a similar manner in each of these related sequences, that is, by playing a central role in transcriptional regulation and in the conferring of shared traits.

Experimental Observations.

The function of G3470 was analyzed through its ectopic overexpression in plants. Seven of ten lines of 35S::G3470 overexpressors were found to be significantly more tolerant to high salt in a plate-based germination assay.

Utilities.

The potential utilities of these two genes, G3395 and G3470, and their equivalogs, include the ability to confer tolerance to drought and other osmotic stresses, including during the germination stage of a crop plant. Equivalogs of G3395 and G3470 include, for example, Arabidopsis sequences G481 (SEQ ID NO: 288), G482 (SEQ ID NO: 290), G485 (SEQ ID NO: 292), G486 (SEQ ID NO: 294), G1248 (SEQ ID NO: 306), G1364 (SEQ ID NO: 308), G1781 (SEQ ID NO: 310), G2345 (SEQ ID NO: 320), G2718 (SEQ ID NO: 324), rice sequences G3394 (SEQ ID NO: 330), G3396 (SEQ ID NO: 334), G3397 (SEQ ID NO: 336), G3398 (SEQ ID NO: 338), G3429 (SEQ ID NO: 358), G3835 (SEQ ID NO: 414), G3836 (SEQ ID NO: 416), corn sequences G3434 (SEQ ID NO: 362), G3435 (SEQ ID NO: 364), G3436 (SEQ ID NO: 366), G3437 (SEQ ID NO: 368), and soy sequences G3470 (SEQ ID NO: 394), G3471 (SEQ ID NO: 396), G3472 (SEQ ID NO: 398), G3473 (SEQ ID NO: 400), G3474 (SEQ ID NO: 402), G3475 (SEQ ID NO: 404), G3476 (SEQ ID NO: 406), G3477 (SEQ ID NO: 408), G3478 (SEQ ID NO: 410), and G3837 (SEQ ID NO: 418).

HAP5 Transcription Factor Polypeptides

G1820 (SEQ ID NO: 243 and 244)

G1820 is a member of the Hap5 subfamily of CCAAT-box-binding transcription factors. G1820 was identified as part of the BAC clone MBA10, accession number AB025619 released by the Arabidopsis Genome sequencing project. G1820 and closely-related clade member sequences each comprise a conserved CCAAT binding factor domain that is expected to function in a similar manner in each of these related sequences, that is, by playing a central role in transcriptional regulation and in the conferring of shared traits.

Experimental Observations.

The complete sequence of G1820 was determined. The function of this gene was analyzed using transgenic plants in which G1820 was expressed under the control of the 35S promoter. G1820 overexpressing lines showed more tolerance to salt stress in a germination assay. They also showed insensitivity to ABA, with the three lines analyzed showing the phenotype. The salt and ABA phenotypes could be related to the plants' increased tolerance to osmotic stress, which was subsequently confirmed in soil-based drought assays in which 35S::G1820 plants were significantly more drought-tolerant than wild-type control plants (Tables 11 and 12).

Interestingly, overexpression of G1820 also consistently reduced the time to flowering. Under continuous light conditions at 20-25 C, the 35S::G1820 transformants displayed visible flower buds several days earlier than control plants. The primary shoots of these plants typically started flower initiation 1-4 leaf plastochrons sooner than those of wild type. Such effects were observed in all three T2 populations and in a substantial number of primary transformants.

When biochemical assays were performed, some changes in leaf fames were detected. In one line, an increase in the percentage of 18:3 and a decrease in 16:1 were observed. Otherwise, G1820 overexpressors behaved similarly to wild-type controls in all biochemical assays performed. As determined by RT-PCR, G1820 was highly expressed in embryos and siliques. No expression of G1820 was detected in the other tissues tested. G1820 expression appeared to be induced in rosette leaves by cold and drought stress treatments, and overexpressing lines showed tolerance to water deficit and high salt conditions.

One possible explanation for the complexity of the G1820 overexpression phenotype is that the gene is somehow involved in the cross talk between ABA and GA signal transduction pathways. It is well known that seed dormancy and germination are regulated by the plant hormones ABA and gibberellin (GA). These two hormones act antagonistically with each other. ABA induces seed dormancy in maturing embryos and inhibits germination of seeds. GA breaks seed dormancy and promotes germination. It is conceivable that the flowering time and ABA insensitive phenotypes observed in the G1820 overexpressors are related to an enhanced sensitivity to GA, or an increase in the level of GA, and that the phenotype of the overexpressors is unrelated to ABA. In Arabidopsis, GA is thought to be required to promote flowering in non-inductive photoperiods. However, the drought and salt tolerant phenotypes would indicate that ABA signal transduction is also perturbed in these plants. It seems counterintuitive for a plant with salt and drought tolerance to be ABA insensitive since ABA seems to activate signal transduction pathways involved in tolerance to salt and dehydration stresses. One explanation is that ABA levels in the G1820 overexpressors are also high but that the plant is unable to perceive or transduce the signal.

G1820 overexpressors also had decreased seed oil content and increased seed protein content compared to wild-type plants Utilities.

G1820 and its equivalogs may be used to enhance a plant's tolerance to drought conditions. The osmotic stress results indicated that G1820 or its equivalogs could be used to alter a plant's response to additional water deficit conditions and can be used to engineer plants with enhanced tolerance to salt stress, and freezing. Evaporation from the soil surface causes upward water movement and salt accumulation in the upper soil layer where the seeds are placed. Thus, germination normally takes place at a salt concentration much higher than the mean salt concentration of in the whole soil profile. Increased salt tolerance during the germination stage of a crop plant would impact survivability and yield.

G1820 affects ABA sensitivity, and thus when transformed into a plant this transcription factor or its equivalogs may diminish cold, drought, oxidative and other stress sensitivities, and also be used to alter plant architecture, and yield.

G1820 or its equivalogs could also be used to accelerate flowering time.

G1820 or its equivalogs may be used to modify levels of saturation in oils.

G1820 or its equivalogs may be used to seed protein content.

The promoter of G1820 could be used to drive seed-specific gene expression.

G1820 or equivalog overexpression may be used to alter seed protein content, which may be very important for the nutritional value and production of various food products G489 (SEQ ID NO: 229 and 230)

G489 was identified from a BAC sequence that showed high sequence homology to AtHAP5-like transcription factors in *Arabidopsis*. G489 and closely-related clade member sequences each comprise a conserved CCAAT binding factor domain that is expected to function in a similar manner in each of these related sequences, that is, by playing a central role in transcriptional regulation and in the conferring of shared traits.

Experimental Observations.

The function of G489 was analyzed through its ectopic overexpression in plants.

RT-PCR analysis of endogenous levels of G489 transcripts indicates that this gene is expressed constitutively in all tissues tested. A cDNA array experiment confirms the RT-PCR derived tissue distribution data. G489 was not induced above basal levels in response to the stress treatments tested.

G489 overexpressors were more tolerant to high NaCl stress, showing more root growth and leaf expansion compared to the controls in culture. Two well characterized ways in which NaCl toxicity is manifested in the plant is through general osmotic stress and potassium deficiency due to the inhibition of its transport. These lines were more tolerant to osmotic stress, showing more root growth on mannitol containing media; however, they were not more tolerant to potassium deficiency.

The involvement of G489 in a response pathway to abiotic stress was further confirmed in soil-based drought assays, where the overexpressors were observed to be more tolerant to water deprivation conditions than wild-type control plants (Table 12).

Utilities.

The potential utilities of this gene include the ability to confer drought and salt tolerance during the growth and developmental stages of a crop plant. This would most likely impact yield and or biomass.

The G916 Clade of Transcription Factor Polypeptides
G916 (SEQ ID NO: 235 and 236)

G916 corresponds to gene At4g04450, and it has also been described as WRKY42. No information is available about the function(s) of G916. G916 and closely-related clade member sequences each comprise a conserved WRKY DNA-binding domain that is expected to function in a similar manner in each of these related sequences, that is, by playing a central role in transcriptional regulation and in the conferring of shared traits.

Experimental Observations.

The complete cDNA sequence of G916 was experimentally determined. G916 appears to be expressed at low levels in a range of tissues, and was not significantly induced by any of the conditions tested.

A T-DNA insertion mutant for G916, displayed wild-type morphology. Overexpression of G916 produced a wide spectrum of developmental abnormalities in *Arabidopsis*. Many of the 35S::G916 seedlings were extremely tiny and showed an apparent lack of shoot organization. Such plants arrested growth and died at very early stages. Other individuals were small and displayed disproportionately long hypocotyls and narrow cotyledons. At later stages, the majority of surviving lines were markedly smaller than wild type, and formed rather weedy inflorescence stems that yielded very few flowers. Additionally, flowers often had poorly developed organs.

In addition, G916 overexpressing lines were larger than control wild-type seedlings in several germination assays. Larger seedlings were observed under conditions of high sucrose. In addition, 35S::G916 seedlings were larger and appeared to have less anthocyanin on high sucrose plates that were nitrogen deficient, with or without glutamine supplementation. The assays monitor the effect of C on N signaling through anthocyanin production. That 35S::G916 seedlings performed better under conditions of high sucrose alone makes it more difficult to interpret the better seedling performance under conditions of low nitrogen. Tissue-specific or inducible expression of this gene could aid in sorting out the complex phenotypes caused by the constitutive overexpression of this gene.

The results of the high sucrose assays indicated that G916-overexpressing plants might be significantly more drought tolerant than control plants, which was subsequently confirmed in soil-based drought assays (Tables 11 and 12).

Utilities.

The results of physiological assays indicate that G916 could be used to alter the sugar signaling in plants. The soil-based drought and sugar sensing assays indicate that G916 and its equivalogs may also be used to enhance a plant's drought or other osmotic stress tolerance.

The enhanced performance of G916 overexpression lines under low nitrogen conditions indicate that the gene could be used to engineer crops that could thrive under conditions of reduced nitrogen availability.

That 35S::G916 lines make less anthocyanin on high sucrose plus glutamine, indicates G916 might be used to modify carbon and nitrogen status, and hence assimilate partitioning.

Additionally, the morphological phenotypes shown by 35S::G916 seedlings indicate that the gene might be used to manipulate light responses such as shade avoidance.

The G2701 Clade of Transcription Factor Polypeptides
G2701 (SEQ ID NO: 245 and 246)

G2701 was identified in the sequence of BAC F11B9, GenBank accession number AC073395, released by the *Arabidopsis* Genome Initiative. G2701 and closely-related clade member sequences each comprise at least one conserved Myb-related DNA-binding domain that is expected to function in a similar manner in each of these related sequences, that is, by playing a central role in transcriptional regulation and in the conferring of shared traits.

Experimental Observations.

The function of G2701 was analyzed using transgenic plants in which the gene was expressed under the control of the 35S promoter. Overexpression of G2701 is Arabidopsis resulted in plants that were wild-type in morphology and in the biochemical analyses performed. However, 35S::G2701 transgenic plants were more tolerant to osmotic stress in a germination assay, the seedlings were greener with expanded cotyledons and longer roots than wild-type controls when germinated on plates containing either high salt or high sucrose. The phenotype was repeated in all three lines.

The results of the high sucrose and salt assays suggested that this gene would confer increased tolerance to other abiotic stresses when G2701 is overexpressed, which was subsequently confirmed in soil-based drought assays, in which 35S::G2701 plants were significantly more drought tolerant than wild-type control plants (Tables 11 and 12).

G2701 was expressed ubiquitously in Arabidopsis according to RT-PCR, and the level of G2701 expression in leaf tissue was essentially unchanged in response to environmental stress related conditions.

Utilities.

G2701 or its equivalogs could be used to alter a plant's response to water deficit conditions and therefore, could be used to engineer plants with enhanced tolerance to drought, salt stress, and freezing.

The G2854 Clade of Transcription Factor Polypeptides
G2854 (SEQ ID NO: 251 and 256)

The sequence of G2854 was obtained from the Arabidopsis genome sequencing project, GenBank accession number AL161566, nid=7269538, based on its sequence similarity within the conserved domain to other ACBF-like related proteins in Arabidopsis. G2854 and closely-related clade member sequences each comprise at least one conserved RNA Recognition Motif (RRM; also known as an RBD or RNP domain) that is expected to function in a similar manner in each of these related sequences, that is, by playing a central role in transcriptional regulation and in the conferring of shared traits.

Experimental Observations.

The 5' and 3' ends of G2854 were determined by RACE. The function of G2854 was analyzed using transgenic plants in which G2854 was expressed under the control of the 35S promoter. 35S::G2854 transformants showed increased germination efficiency on sucrose plates compared to wild-type controls. These results suggested a possible role for G2854 in conferring drought tolerance in plants. This supposition was confirmed in soil-based drought assays, in which plants overexpressing G2854 performed significantly better than wild-type plants (Tables 11 and 12).

Utilities.

G2854 and its equivalogs may be used to confer improved drought tolerance in plants.

G2854 and its equivalogs might also be used to generate crop plants with altered sugar sensing. Sugars are key regulatory molecules that affect diverse processes in higher plants including germination, growth, flowering, senescence, sugar metabolism and photosynthesis. Sucrose is the major transport form of photosynthate and its flux through cells has been shown to affect gene expression and alter storage compound accumulation in seeds (source-sink relationships). Glucose-specific hexose-sensing has been described in plants and implicated in cell division and repression of famine genes (photosynthetic or glyoxylate cycles). The potential utilities of a gene involved in glucose-specific sugar sensing are to alter energy balance, photosynthetic rate, carbohydrate accumulation, biomass production, source-sink relationships, and senescence.

The G634 Clade of Transcription Factor Polypeptides
G634 (SEQ ID NO: 231 and 232)

G634 was initially identified as public partial cDNAs sequences for GTL1 and GTL2 which are splice variants of the same gene (Small et al (1998) Proc. Natl. Acad. Sci. USA. 95:3318-3322). The published expression pattern of GTL1 shows that G634 is highly expressed in siliques and not expressed in leaves, stems, flowers or roots. G634 and closely-related clade member sequences each comprise at least one conserved TH domain that is expected to function in a similar manner in each of these related sequences, that is, by playing a central role in transcriptional regulation and in the conferring of shared traits.

Experimental Observations.

The boundaries of G634 in were experimentally determined and the function of G634 was investigated by constitutively expressing G634 using the CaMV 35S promoter.

Three constructs were made for G634: P1374, P324, and P1717 (SEQ ID NOs: 1013, 1015 and 1017, respectively). P324 was found to encode a truncated protein. P1374 and P1717 represent full length splice variants of G634; P1374, the shorter of the two splice variants was used for the experiments described here. The longest available cDNA (P1717), confirmed by RACE, has the same ATG and stop codons as the genomic sequence.

Plants overexpressing G634 from construct P1374 showed a dramatic increase the density of trichomes, which additionally appear larger in size. The increase in trichome density was most noticeable on later arising rosette leaves, cauline leaves, inflorescence stems and sepals with the stem trichomes being more highly branched than controls. Approximately half of the primary transformants and two of three T2 lines showed the phenotype. Apart from slight smallness, there did not appear to be any other clear phenotype associated with the overexpression of G634. However, a reduction in germination was observed in T2 seeds grown in culture. It is not clear whether this defect was due to the quality of the seed lot tested or whether this characteristic is related to the transgene overexpression.

RT PCR data showed that G634 is potentially preferentially expressed in flowers and germinating seedlings, and induced by auxin. The role of auxin in trichome initiation and development has not been established in the published literature.

The increase in trichome density observed in G634 overexpressors suggested a possible role for this gene in drought-stress tolerance, a presumption subsequently confirmed in soil-based drought assays (Tables 11 and 12).

Utilities.

Trichome glands on the surface of many higher plants produce and secrete exudates that give protection from the elements and pests such as insects, microbes and herbivores. These exudates may physically immobilize insects and spores, may be insecticidal or anti-microbial or they may allergens or irritants to protect against herbivores. Trichomes have also been suggested to decrease transpiration by decreasing leaf surface air flow, and by exuding chemicals that protect the leaf from the sun.

Depending on the plant species, varying amounts of diverse secondary biochemicals (often lipophilic terpenes)

are produced and exuded or volatilized by trichomes. These exotic secondary biochemicals, which are relatively easy to extract because they are on the surface of the leaf, have been widely used in such products as flavors and aromas, drugs, pesticides and cosmetics. One class of secondary metabolites, the diterpenes, can effect several biological systems such as tumor progression, prostaglandin synthesis and tissue inflammation. In addition, diterpenes can act as insect pheromones, termite allomones, and can exhibit neurotoxic, cytotoxic and antimitotic activities. As a result of this functional diversity, diterpenes have been the target of research several pharmaceutical ventures. In most cases where the metabolic pathways are impossible to engineer, increasing trichome density or size on leaves may be the only way to increase plant productivity.

Thus, the use of G634 and its equivalogs to increase trichome density, size or type may therefore have profound utilities in so called molecular farming practices (i.e. the use of trichomes as a manufacturing system for complex secondary metabolites), and in producing resistant insect and herbivore resistant plants.

G634 and its equivalogs may also be used to increase the drought tolerance of plants.

The G175 Clade of Transcription Factor Polypeptides
G175 (SEQ ID NO: 223 and 224)

G175 was identified in the sequence of P1 clone M3E9 (Gene AT4g26440/M3E9.130; GenBank accession number CAB79499). G175 and closely-related clade member sequences each comprise a conserved WRKY DNA-binding domain that is expected to function in a similar manner in each of these related sequences, that is, by playing a central role in transcriptional regulation and in the conferring of shared traits.

Experimental Observations.

The complete cDNA sequence of G175 was determined by us. The function of this gene was studied using transgenic plants in which G175 was expressed under the control of the 35S promoter. 35S::G175 plants are more tolerant to osmotic stress conditions (better germination in NaCl and sucrose containing media). The plants were otherwise wild-type in morphology and development.

G175 appears to be specifically expressed in floral tissues, and also appears to be induced elsewhere by heat and salt stress.

The results of the osmotic stress assays and heat and salt stress expression analyses suggested that G175 could be used to confer drought tolerance in plants, a supposition that was confirmed in soil-based assays in which G175-overexpressing plants were shown to be more tolerant to water deprivation than wild-type control plants (Tables 11 and 12).

Utilities.

G175 and its equivalogs can be used to improve drought tolerance and increase germination under adverse osmotic stress conditions, which could impact survivability and yield. The promoter of G175 could also be used to drive flower specific expression.

The G1452 Clade of Transcription Factor Polypeptides
G1452 (SEQ ID NO: 241 and 242)

G1452 was identified in the sequence of clones T22O13, F12K2 with accession number AC006233 released by the *Arabidopsis* Genome Initiative. G1452 and closely-related clade member sequences each comprise a conserved NAC domain that is expected to function in a similar manner in each of these related sequences, that is, by playing a central role in transcriptional regulation and in the conferring of shared traits.

Experimental Observations.

The function of G1452 was analyzed using transgenic plants in which the gene was expressed under the control of the 35S promoter. G1452 and closely-related clade member sequences each comprise a conserved NAC domain that is expected to function in a similar manner in each of these related sequences, that is, by playing a central role in transcriptional regulation and in the conferring of shared traits.

Overexpression of G1452 produced changes in leaf development and markedly delayed the onset of flowering. 35S::G1452 plants produced dark green, flat, rounded leaves, and typically formed flower buds between 2 and 14 days later than controls. Additionally, some of the transformants were noted to have rather low trichome density on leaves and stems. At later stages of life cycle, 35S::G1452 appeared to develop slowly and senesced considerably later than wild-type controls.

G1452 overexpressors were more tolerant to high sucrose-induced osmotic stress than wild-type control plants, were more tolerant to high salt than controls, and were insensitive to ABA in separate germination assays. These results indicated that G1452 may be used to confer improved survival in drought, which was confirmed in soil-based drought assays where G1452-overexpressors fared significantly better than wild-type control plants (Tables 11 and 12).

Utilities.

G1452 could be used to alter a plant's response to water deficit conditions and therefore, could be used to engineer plants with enhanced tolerance to drought and salt stress.

On the basis of the analyses performed to date, G1452 could be use to alter plant growth and development.

The G3083 Clade of Transcription Factor Polypeptides
G3083 (SEQ ID NO: 253 and 254)

G3083 (At3g14880) was identified as part of the BAC clone K15M2, GenBank accession number AP000370 (nid=5541653). G3083 and closely-related clade member sequences each comprise a conserved domain that is expected to function in a similar manner in each of these related sequences, that is, by playing a central role in transcriptional regulation and in the conferring of shared traits.

Experimental Observations.

The 5'- and 3'-ends of G3083 were determined by RACE and the function of the gene was assessed by analysis of transgenic *Arabidopsis* lines in which a genomic clone was constitutively expressed from a 35S promoter. 35S::G3083 plants were indistinguishable from wild-type controls in the morphological analysis.

In the physiological analysis, two out of the three 35S::G3083 lines tested, displayed an enhanced ability to germinate on plates containing high levels of sodium chloride. This suggested that G3083 might function as part of a response pathway to abiotic stress, which was further indicated in soil-based drought assays in which one line of a G3083 overexpressor was shown to be significantly more tolerant to water deprivation than wild-type control plants.

Utilities

Based on the increased salt tolerance exhibited by the 35S::G3083 lines in physiology assays, this gene might be used to engineer salt tolerant crops and trees that can flourish in drought or in salinified soils. The latter condition is of particular importance early in the lifecycle, since evaporation from the soil surface causes upward water movement, and salt accumulates in the upper soil layer where the seeds are placed. Thus, germination normally takes place at a salt concentration much higher than the mean salt level in the whole soil profile. Increased salt tolerance during the germination stage of a crop plant would therefore enhance survivability and yield.

The G303 Clade of Transcription Factor Polypeptides
G303 (SEQ ID NO: 225 and 226)

G303 corresponds to gene MNA5.5 (BAB11554.1). G303 and closely-related clade member sequences each comprise a conserved HLH DNA-binding and dimerization domain that is expected to function in a similar manner in each of these related sequences, that is, by playing a central role in transcriptional regulation and in the conferring of shared traits.

Experimental Observations.

The complete sequence of G303 was determined. G303 was detected at very low levels in roots and rosette leaves. It did not appear to be induced by any condition tested. No altered morphological or biochemical phenotypes were detected in G303 overexpressing plants.

The function of this gene was analyzed using transgenic plants in which G303 was expressed under the control of the 35S promoter. G303 overexpressing plants showed more tolerance to osmotic stress vigor than wild-type controls in a germination assay in three separate experiments on high salt and high sucrose.

The involvement of G303 in a response pathway to abiotic stress was further confirmed in soil-based drought assays, in which the plants overexpressing G303 were found to be more tolerant to drought than the wild-type controls in the experiment (Table 12).

Utilities.

G303 may be useful for enhancing drought tolerance and seed germination under high salt conditions or other conditions of osmotic stress (for example, freezing).

The G682 subclade of Transcription Factor Polypeptides
G682 (SEQ ID NO: 233 and 234)

G682 was identified from the *Arabidopsis* BAC, AF007269, based on sequence similarity to other members of the Myb family within the conserved domain. G682 and closely-related clade member sequences each comprise a conserved Myb-related DNA-binding domain that is expected to function in a similar manner in each of these related sequences, that is, by playing a central role in transcriptional regulation and in the conferring of shared traits.

Experimental Observations.

The function of G682 was analyzed through its ectopic overexpression in plants.

RT-PCR analysis of the endogenous levels of G682 transcripts indicated that this gene is expressed in all tissues tested, however, a very low level of transcript is detected in roots and shoots. Array tissue print data suggests that G682 is expressed primarily, but not exclusively, in flower tissue.

G682 overexpressors were glabrous and had tufts of more root hairs.

An array experiment was performed on G682 overexpressing line 5. The data from this one experiment indicates that this gene could be a negative regulator of chloroplast development and/or light dependent development because the gene Albino3 and many chloroplast genes are repressed. Albino3 functions to regulate chloroplast development (Plant Cell (1997) 9: 717-730). The gene G682 is itself is induced 20-fold. Other than a few additional transcription factors, very few genes are induced as a result of the ectopic expression of G682. These plants are not pale in color, making it uncertain how to relate the morphological and physiological data with the gene profiling data. The array experiment needs to be repeated with additional lines.

The effects of a high salt environment (MS medium supplemented with 150 mM NaCl) on the germination of G682 overexpressors and control seedlings was studied. The results demonstrated that the overexpressors were more tolerant to the high salt concentration, being much larger and greener than controls. High sodium chloride growth assays often are used to indicate abiotic stress tolerance such as osmotic stress tolerance, including drought tolerance, which was subsequently confirmed with soil-based drought assays conducted with plants overexpressing G682.

G682-overexpressing line were found to be larger and greener than wild-type controls that were similarly treated in a cold germination assay (8° C.), indicating enhanced tolerance of the former to germination in these cold conditions.

G682 overexpressors were larger and greener in sucrose germination assays than wild-type controls, indicating that G682 overexpression can confer a sugar-sensing or abiotic stress phenotype. This assay is used to determine whether a plant has an altered sugar sensing response or altered abiotic stress tolerance, and, in this case, indicates that overexpression of G682 can confer this phenotype in plants.

In a heat germination assay (32° C. to 37° C. for 6 hours of exposure), G682 overexpressing seedlings were significantly larger, greener and had greater cotyledon expansion than wild type seedlings. In subsequent experiments, it was found that older plants were also more tolerant to heat stress compared to wild-type controls. At the time these experiments were performed, it was suggested that further experiments were needed to address whether or not the heat germination phenotype of the G682 overexpressors was related to water deficit stress tolerance in the germinating seedling, and correlated with a possible drought tolerance phenotype. More recent experiments have shown that G682 overexpressors were, on average, more tolerant to water deprivation conditions in soil-based drought assays than wild-type plants (Table 12), and two of three lines were significantly more drought tolerant than the wild-type controls.

Utilities.

The utility of this gene and its equivalogs would be to confer salt, heat and cold tolerance to germinating seeds and plants, and drought tolerance in plants.

G1816 (SEQ ID NO: 311 and 312)

G1816 is a paralog of G682 from *Arabidopsis*. G1816 is a member of the MYB-related class of transcription factors. The gene corresponds to TRIPTYCHON (TRY), and has recently been shown to be involved in the lateral inhibition during epidermal cell specification in the leaf and root (Schellmann et al. (2002) *EMBO J.* 21: 5036-5046). The model proposes that TRY (G1816) and CPC (G225) function as repressors of trichome and atrichoblast cell fate. TRY loss-of-function mutants form ectopic trichomes on the leaf surface. TRY gain-of-function mutants are glabrous and form ectopic root hairs. G1816 and closely-related clade member sequences each comprise a conserved Myb-related DNA-binding domain that is expected to function in a similar manner in each of these related sequences, that is, by playing a central role in transcriptional regulation and in the conferring of shared traits.

Experimental Observations.

The complete sequence of G1816 was determined. The function of the gene was studied using transgenic plants in which G1816 was expressed under the control of the 35S promoter. Consistent with the morphological phenotypes published for the 35S::TRY overexpressors, the transgenic plants were glabrous and form ectopic root hairs.

The 35S::G1816 plants were also insensitive to growth retardation effects of germination on conditions of high glucose and sucrose (MS medium supplemented with 5% glucose and 9.4% sucrose, respectively); the overexpressor seedlings were large and green, as contrasted with the wild-type control seedlings which were significantly smaller and more pigmented. This indicates that G1816 plays a role in sugar sensing responses in the plant or osmotic stress tolerance.

A number of G1816 overexpressing lines were more tolerant to drought conditions than wild-type controls in soil-based assays.

Utilities.

The phenotypic effects of G1816 overexpression, such as the increase in root hair formation and the increase in seedling vigor observed in a germination assay on high glucose media, indicated that the gene or its orthologs can be used to engineer plants with increased tolerance to abiotic stresses such as drought, salt, heat or cold.

In addition, the enhanced performance of G1816 overexpression lines under low nitrogen conditions indicated that the gene or its orthologs could be used to engineer crops that could thrive under conditions of reduced nitrogen availability. These assays also indicate that G1816 and its equivalogs are potential regulators of a plant's C/N sensing, nitrogen uptake and utilization, and its response to low nutrient conditions. For further analysis, see the discussion above: "Potential Applications of Polynucleotides and Polypeptides that Regulate C/N sensing".

The effect of G1816 overexpression on insensitivity to glucose in a germination assay, indicated that the gene or its orthologs could be involved in sugar sensing responses in the plant.

G1816 or its orthologs could also be used to alter anthocyanin production and trichome formation in leaves.

The potential utilities of genes involved in anthocyanin production include alterations in pigment production for horticultural purposes and increase stress resistance perhaps in combination with other transcription factors. Flavonoids have antimicrobial activity and could be used to engineer pathogen resistance. In addition, several flavonoid compounds have health promoting effects such as the inhibition of tumor growth and cancer, prevention of bone loss and the prevention of the oxidation of lipids.

G3450 (SEQ ID NO: 319 and 320)

G3450 is a soy ortholog or G682. Almost all of the 35S::G3450 lines examined were glabrous and had more root hair than controls, thus exhibiting a morphology similar to G682. G3450 and closely-related clade member sequences each comprise a conserved Myb-related DNA-binding domain that is expected to function in a similar manner in each of these related sequences, that is, by playing a central role in transcriptional regulation and in the conferring of shared traits.

Experimental Observations.

In plate-based assays, G3450 overexpressors were more tolerant to germination and growth in cold conditions, and growth in heat.

At least four lines of G3450 overexpressors were more tolerant to drought treatment than wild-type controls in soil-based assays. After rewatering, these same lines also exhibited much superior recovery from the effects of the drought treatment than the controls, as evidenced by their return to vigor (many of the control plants were dead at this point).

Utilities.

Similar to other members of the G682 subclade, G3450 or its equivalogs can be used to engineer plants with increased tolerance to abiotic stresses such as drought, heat or cold.

Summary of Drought Assay Results

Table 11 presents the results obtained in an assay in which *Arabidopsis* plants were subjected to water deprivation for seven to eight days. At the end of this dry-down period, each pot was assigned a numeric score depending on the health of its plants. A score of 0 to 6 was assigned based on a plant's color and general appearance, with plants that were all brown receiving a "0" and, at the other end of the spectrum, plants that had an excellent appearance (all green) receiving a "6". The mean of the recorded numeric score of all pots of a given genotype per line of all flats tested is presented in order of decreasing health.

TABLE 11

Comparison of recorded numeric score plants subjected to drought treatment.

| GID | Mean score |
| --- | --- |
| G2133 | 5.875 |
| G634 | 4.778 |
| G922 | 4.667 |
| G916 | 4.6 |
| G1274 | 4.273 |
| G864 | 3.733 |
| G2999 | 3.7 |
| G2992 | 3.7 |
| G353 | 3.6 |
| G47 | 3.459 |
| G2053 | 3.404 |
| G975 | 3.393 |
| G489 | 3.364 |
| G1792 | 3.281 |
| G1820 | 3.2 |
| G2453 | 3.2 |
| G2140 | 3.139 |
| G2701 | 3.108 |
| G3086 | 3.056 |
| G611 | 3.048 |
| G1452 | 3.042 |
| G481 | 3.041 |
| G624 | 3.000 |
| G2854 | 2.829 |
| G303 | 2.812 |
| G2839 | 2.783 |
| G2789 | 2.708 |
| G188 | 2.692 |
| G325 | 2.556 |
| G2776 | 2.513 |
| G175 | 2.467 |
| G2110 | 2.432 |
| G1206 | 2.412 |
| G682 | 2.381 |
| G1730 | 2.341 |
| G2969 | 2.333 |
| G2998 | 2.333 |
| G1069 | 2.316 |
| Wild-type | 2.284 |

Table 12 compares the survival ratings of *Arabidopsis* plants overexpressing various polypeptides, evaluated after seven to eight days of drought treatment, rewatering, and two to three days of a recovery period Values indicate the median odds of survival within a given flat (the 50th percentile of survival within each pot of a given genotype per line divided by the average wild-type survival in the flat).

TABLE 12

Survival ratings of *Arabidopsis* plants after drought and rewatering treatment

| GID | Median per flat |
|---|---|
| G2133 | 3.365 |
| G1274 | 2.059 |
| G922 | 1.406 |
| G2999 | 1.255 |
| G3086 | 1.179 |
| G354 | 1.167 |
| G1792 | 1.161 |
| G2053 | 1.091 |
| G975 | 1.090 |
| G1069 | 1.037 |
| G916 | 1.023 |
| G2701 | 1.000 |
| G1820 | 1.000 |
| G47 | 0.921 |
| G2854 | 0.889 |
| G2789 | 0.845 |
| G481 | 0.843 |
| G634 | 0.834 |
| G175 | 0.814 |
| G2839 | 0.805 |
| G1452 | 0.803 |
| Wild-type | 0.800 |

Example IX: Results of C/N Sensing Assays

This example provides experimental evidence for altered carbon-nitrogen balance controlled by transcription factor polypeptides and polypeptides of the invention.
The G682 subclade of Transcription Factor Polypeptides G682 (SEQ ID NO: 233 and 234)

G682 was identified from the *Arabidopsis* BAC, AF007269, based on sequence similarity to other members of the Myb family within the conserved domain. G682 and closely-related clade member sequences each comprise a conserved Myb-related DNA-binding domain that is expected to function in a similar manner in each of these related sequences, that is, by playing a central role in transcriptional regulation and in the conferring of shared traits.

Experimental Observations.

The function of G682 was analyzed through its ectopic overexpression in plants.

RT-PCR analysis of the endogenous levels of G682 transcripts indicated that the gene is expressed in all tissues. However, only a very low level of transcript was detected in roots and shoots. The function of G682 was analyzed through its ectopic overexpression. 35S::G682 lines were glabrous, had tufts of increased root hair density and showed better germination under drought related stress (heat). In one of the genomics experiments, it was also noted that 35S:: G682 lines showed a slightly enhanced performance on potassium limited media.

We have now analyzed 35S::G682 seedlings in a C/N sensing assay by comparing the effects of G682-overexpressing lines germinating on N–/S medium (MS media minus nitrogen plus 3% sucrose) with control wild-type seedlings on the same medium. The overexpressors of these lines were found to produce much less anthocyanin, indicating that G682 likely has a role in nitrogen utilization and in the response to low nutrient conditions.

The phenotypic effects described for 35S::G682 overexpressing plants in the C/N sensing assay is similar to that observed for 35S lines from other members of the G682 subclade (G226, G682, G1816, and 2718). Similarly, plants that overexpress any of the G682 *Arabidopsis* 35S CaMV clade members have been observed to have increased root hair formation and reduced anthocyanin levels in C/N sensing assays. Additionally, *Arabidopsis* G682 subclade member (Table 13) and non-*Arabidopsis* G682 subclade members, including soy and corn sequences, have also been shown in laboratory experiments to confer tolerance to various abiotic stresses (Table 13).

Thus, the entire clade of G682-related genes appear to have very related functions and those that have been so tested have been shown to be involved in the response to nitrogen limitation. As such, these sequences are likely to be good candidates for improving the efficiency of nutrient utilization and tolerance to other stresses in commercial crops. Thus, the G682-related genes could afford yield savings via multiple different traits.

Table 13 lists the results obtained in several abiotic stress assays in which a number of members of the G682 subclade were overexpressed in *Arabidopsis* plants. For all genes, assays were performed in which expression was under the control of the cauliflower mosaic virus 35S transcription initiation region. For G682, assays were also performed with transgenic plants in which expression was controlled as indicated in the second column. Control of expression of G682 was performed using ARSK1, a root-specific protein kinase gene promoter, the CUT1 promoter, which controls production of epicuticular wax in bolting stems and is used for epidermis-specific expression, and by superactivation, in which an expression vector having a GAL4 activation domain is fused to the G682 sequence to create an N-terminal GAL4 activation domain protein fusion. The first and second columns identify the sequence test by SEQ ID NO: and Gene Identification Number. The third column identifies the species in which the gene originated. The fourth through eleventh columns list the ratio of transgenic *Arabidopsis* lines with an altered phenotype relative to controls, over the number of lines tested. These results show increased germination in high salt, increased germination in high mannitol, increased germination in high sucrose, decreased sensitivity to ABA, increased germination in heat, increased tolerance to heat in a growth assay, increased germination in cold conditions, and increased tolerance to cold in a growth assay (chilling), respectively. The column labeled "C/N" identifies the sequences that were tested and conferred altered C/N sensing of the plants (in each of these case, less anthocyanin was produced by the seedlings in the C/N sensing assays). "Low N tol." refers to decreased sensitivity, relative to controls, to low nitrogen conditions in plate-based assays. The column labeled "Morph" identifies the sequences that exhibited a glabrous phenotype with increased root hairs, the latter being of particular interest in that this trait may help confer abiotic stress tolerance. The last column indicates the lines that were positive in a soil-based drought assay.

TABLE 13

Results of abiotic stress experiments with G682-related sequences

| SEQ ID NO: | GID | Species | Germ in NaCl | Mann | Sucr | ABA | Germ in Heat | Grth in Heat | Germ in Cold | Grth in cold | C/N sens | Low N tol. | Morph | Drought tol. |
|---|---|---|---|---|---|---|---|---|---|---|---|---|---|---|
| 234 | 35S::G682 | A. thaliana | 9/10 | 3/10 | 10/10 | 6/10 | 3/10 | 0/10 | 0/10 | 0/10 | + | nc | + | + |
| 234 | ARSK1::G682 | A. thaliana | 0/10 | 0/10 | 0/10 | 0/10 | 0/10 | 0/10 | 2/10 | 0/10 | nc | nc | wt | + |
| 234 | CUT1::G682 | A. thaliana | 6/10 | 0/10 | 0/10 | 0/10 | 0/10 | 0/10 | 1/10 | 0/10 | nc | nc | wt | wt |
| 234 | SA G682 | A. thaliana | 2/10 | 0/10 | 0/10 | 0/10 | 0/10 | 1/10 | 0/10 | 0/10 | nc | nc | + | wt |
| 285 | G226 | A. thaliana | 0/9 | 0/9 | 5/9 | 8/9 | 0/9 | 0/9 | 2/9 | 2/9 | + | + | + | nc |
| 286 | G1816 | A. thaliana | 0/10 | 0/10 | 10/10 | 0/10 | 0/10 | 0/10 | 0/10 | 0/10 | + | + | + | nc |
| 323 | G2718 | A. thaliana | nc | nc | nc | nc | nc | nc | nc | nc | + | + | + | nc |
| 324 | G3393 | Oryza sativa | 0/10 | 0/10 | 1/10 | 0/10 | 0/10 | 0/10 | 0/10 | 0/10 | nc | nc | + | nc |
| 360 | G3431 | Z. mays | 0/10 | 0/10 | 4/10 | 0/10 | 2/10 | 0/10 | 0/10 | 0/10 | nc | nc | + | nc |
| 360 | G3444 | Z. mays | 0/10 | 0/10 | 0/10 | 0/10 | 2/10 | 2/10 | 0/10 | 1/10 | nc | nc | + | nc |
| 378 | G3448 | G. max | 0/10 | 0/10 | 0/10 | 0/10 | 0/10 | 0/10 | 0/10 | 3/10 | nc | nc | + | + |
| 380 | G3449 | G. max | 1/10 | 0/10 | 0/10 | 0/10 | 1/10 | 0/10 | 3/10 | 1/10 | nc | nc | + | nc |
| 382 | G3450 | G. max | 2/10 | 0/10 | 0/10 | 0/10 | 1/10 | 3/10 | 6/10 | 5/10 | nc | nc | + | + |

Symbols and abbreviations:
+ phenotype observed
wt result not significantly different from wild-type
Grth Growth
Germ germination
Tol tolerance
Morph morphology
C/N sens carbon/nitrogen balance sensing
Mann growth in high mannitol
Sucr growth in high sucrose
ABA reduced sensitivity to abscisic acid
SA superactivation
nc assay results not completed or performed to date Utilities The utility of this gene and its equivalogs would be to confer heat tolerance to germinating seeds and drought tolerance in plants.

These assays also indicate that G682 and its equivalogs are potential regulators of a plant's C/N sensing, nitrogen uptake and utilization, and its response to low nutrient conditions. For further analysis, see the discussion above: "Potential Applications of Polynucleotides and Polypeptides that Regulate C/N sensing".

G682 equivalogs include, for example, Arabidopsis thaliana SEQ ID NO: 286, 312 and 324 (G226, G1816 and G2718); Oryza sativa (japonica cultivar-group) SEQ ID NO: 326 and 328 (G3392 and G3393); Glycine max SEQ ID NO: 372, 374, 376, 378, 380, and 382 (G3445, G3446, G3447, G3448, G3449, and G3450); and Zea mays SEQ ID NO: 360 and 370 (G3431 and G3444).

G226 (SEQ ID NO: 285 and 286)

G226 is a paralog of G682 from Arabidopsis. G226 (AT2G30420) was identified from the Arabidopsis BAC sequence (GenBank accession AC002338), based on sequence similarity within the conserved domain to other Myb family members in Arabidopsis. G226 and closely-related clade member sequences each comprise a conserved Myb-related DNA-binding domain that is expected to function in a similar manner in each of these related sequences, that is, by playing a central role in transcriptional regulation and in the conferring of shared traits.

Experimental Observations.

RT-PCR expression analysis of the endogenous levels of G226 indicated that the gene is primarily expressed in leaf tissue. The function of G226 was analyzed through its ectopic overexpression. G226 overexpressors were more tolerant to conditions of high salt (Table 13) and low nitrogen (Table 14). The overexpressors were larger and greener and had more root growth and root hairs under conditions of nitrogen limitation than wild-type controls. Many plants were glabrous and lacked anthocyanin production when under stress such as growth conditions of low nitrogen (the medium contained 20 mg/L of $NH_4(NO_3)$ as the nitrogen source).

G226 also showed a salt tolerance phenotype in plate-based salt stress assays (MS medium supplemented with 150 mM NaCl). 35S::G226 seedlings generally appeared larger and greener than wild-type seedlings, the latter being generally smaller with less root mass, and were more chlorotic.

We have now analyzed 35S::G226 seedlings in a C/N sensing assay. Anthocyanin accumulation was significantly less than that observed in control wild-type seedlings, confirming that this gene has a role in the response to nutrient limited conditions. It should be noted that other members of the clade (G226, G682, G1816, G2718 and non-Arabidopsis orthologs) produce similar effects when overexpressed (Tables 13 and 14).

Utilities.

These assays indicate that G226 and its equivalogs are potential regulators of a plant's response to low nutrient conditions. For further analysis, see the discussion above: "Potential Applications of Polynucleotides and Polypeptides that Regulate C/N sensing".

In addition, this gene and its equivalogs could be used to alter seed protein amounts and/or composition, which could impact yield as well as the nutritional value and production of various food products.

G1816 (SEQ ID NO: 311 and 312)

G1816 is a paralog of G682 from *Arabidopsis*. G1816 is a member of the MYB-related class of transcription factors. The gene corresponds to TRIPTYCHON (TRY), and has recently been shown to be involved in the lateral inhibition during epidermal cell specification in the leaf and root (Schellmann et al. (2002) *EMBO J.* 21: 5036-5046). The model proposes that TRY (G1816) and CPC (G225) function as repressors of trichome and atrichoblast cell fate. TRY loss-of-function mutants form ectopic trichomes on the leaf surface. TRY gain-of-function mutants are glabrous and form ectopic root hairs. G1816 and closely-related clade member sequences each comprise a conserved Myb-related DNA-binding domain that is expected to function in a similar manner in each of these related sequences, that is, by playing a central role in transcriptional regulation and in the conferring of shared traits.

Experimental Observations.

The complete sequence of G1816 was determined. The function of the gene was studied using transgenic plants in which G1816 was expressed under the control of the 35S promoter. Consistent with the morphological phenotypes published for the 35S::TRY overexpressors, the transgenic plants were glabrous and form ectopic root hairs.

These transgenic lines were also more tolerant to growth under nitrogen-limiting conditions, both in a germination assay as well as a root growth assay on older seedlings.

In addition to the nitrogen-limiting tolerance phenotypes observed in these transgenic lines, the 35S::G1816 plants were also insensitive to growth retardation effects of germination on conditions of high glucose (MS medium supplemented with 5% glucose); the overexpressor seedlings were large and green, as contrasted with the wild-type control seedlings which were significantly smaller and more pigmented. This indicates that G1816 plays a role in sugar sensing responses in the plant or osmotic stress tolerance. Genes for many sugar-sensing mutants are allelic to genes involved in abscisic acid and ethylene signaling (Rolland et al. (2002) *Plant Cell* 14: Suppl. S185-S205). Therefore, G1816 could also be involved in hormone signaling pathways.

We have now analyzed 35S::G1816 seedlings in a C/N sensing assay. The seedlings in these experiments were germinated on N-/S/Gln medium (MS media minus nitrogen plus 3% sucrose and 1 mM glutamine). The G1816 overexpressing seedlings were found to have less anthocyanin than the control seedlings, indicating that G1816 likely has a role in nitrogen utilization and in the response to low nutrient conditions.

Germination assays were also used to compare G1816 overexpressors and wild-type control seedlings on a low nitrogen medium. The overexpressors were much larger, had no anthocyanin and produced more root growth and root hair density than the wild-type controls.

Utilities.

The phenotypic effects of G1816 overexpression, such as the increase in root hair formation and the increase in seedling vigor observed in a germination assay on high glucose media, indicated that the gene or its orthologs can be used to engineer plants with increased tolerance to abiotic stresses such as drought, salt, heat or cold.

In addition, the enhanced performance of G1816 overexpression lines under low nitrogen conditions indicated that the gene or its orthologs could be used to engineer crops that could thrive under conditions of reduced nitrogen availability. These assays also indicate that G1816 and its equivalogs are potential regulators of a plant's C/N sensing, nitrogen uptake and utilization, and its response to low nutrient conditions. For further analysis, see the discussion above: "Potential Applications of Polynucleotides and Polypeptides that Regulate C/N sensing".

The effect of G1816 overexpression on insensitivity to glucose in a germination assay, indicated that the gene or its orthologs could be involved in sugar sensing responses in the plant.

G1816 or its orthologs could also be used to alter anthocyanin production and trichome formation in leaves.

The potential utilities of genes involved in anthocyanin production include alterations in pigment production for horticultural purposes and increase stress resistance perhaps in combination with other transcription factors. Flavonoids have antimicrobial activity and could be used to engineer pathogen resistance. In addition, several flavonoid compounds have health promoting effects such as the inhibition of tumor growth and cancer, prevention of bone loss and the prevention of the oxidation of lipids.

G2718 (SEQ ID NO: 323 and 324)

G2718 is a paralog of G682 from *Arabidopsis*. G2718 (AT1G01380) was identified in the BAC clone, F6F3 (GenBank accession AC023628). Two highly related genes, TRY and CPC have been implicated in epidermal cell specification. A lateral inhibition model proposes that TRY (G1816) and CPC (G225) function as repressors of trichome and atrichoblast cell fate (Shellmann et al. (2002) *EMBO J.* 21: 5036-5046). A comprehensive review on epidermal cell-fate specification has been published recently (Schiefelbein (2003) *Curr. Opin. Plant Biol.* 6: 74-78). G2718 and closely-related clade member sequences each comprise a conserved Myb-related DNA-binding domain that is expected to function in a similar manner in each of these related sequences, that is, by playing a central role in transcriptional regulation and in the conferring of shared traits.

Experimental Observations.

Results obtained by the overexpression of G1816 in plants, including abiotic stress tolerance and low nitrogen tolerance phenotypes have been previously reported in U.S. patent application Ser. No. 10/714,887, filed Nov. 13, 2003.

The function of G2718 was studied using plants in which the gene was expressed under the control of the 35S promoter. Overexpression of G2718 resulted in a glabrous phenotype. The effect was highly penetrant, being observed in all primary transformants and each of three independent T2 lines. All of the T1 lines showed a very strong phenotype and completely lacked trichomes on leaves and stems. A comparably severe effect was observed in one of the three T2 populations, whereas the other two T2 populations each exhibited a weaker phenotype, indicating that the effect might have become partially silenced between the generations. Trichomes were present in these weaker lines, but at a much lower density than in wild type.

In addition to the effects on trichome density, 35S::G2718 transformants were also generally slightly smaller than wild type controls.

The phenotypic effects above were observed in the 35S::G2718 as well as in all 35S lines from members of the G2718 clade (G225, G226, G1816, and G682). Similarly, 35S::TF lines from the G2718 clade all had increased root hair formation, reduced anthocyanin levels, and showed improved growth under nitrogen limiting conditions.

Overexpressors were generally larger, had more root mass, and were often greener than wild-type control seedlings on low nitrogen media, indicating that overexpression of G2718 confers enhanced tolerance of plants to this low nutrient condition, possibly by improving nutrient uptake.

We have now analyzed 35S::G2718 seedlings in a C/N sensing assay. Anthocyanin accumulation was significantly less than that observed in control plants (Table 14), indicating that G2718 likely has a role in nitrogen utilization and in the response to low nutrient conditions.

Utilities.

The phenotypic effects of G2718 overexpression, such as the increase in root hair formation and the increase in seedling vigor observed in a root growth assay on N-limiting media, indicates that the gene or its equivalogs could be used to engineer plants with increased tolerance to abiotic stresses such as nutrient limitation, drought, salt, heat or cold.

The enhanced performance of G2718 overexpression lines under low nitrogen conditions indicates that the gene or its equivalogs could be used to engineer crops that could thrive under conditions of reduced nitrogen availability. These assays also indicate that G2718 and its equivalogs are potential regulators of a plant's C/N sensing, nitrogen uptake and utilization, and its response to low nutrient conditions. For further analysis, see the discussion above: "Potential Applications of Polynucleotides and Polypeptides that Regulate C/N sensing".

G2718 or its equivalogs could also be used to alter anthocyanin production or trichome formation. and production of secondary biochemicals (e.g., lipophilic terpenes) by trichomes.

G3392 (SEQ ID NO: 325 and 326)

G3392 is a rice ortholog of G682. G3392 and closely-related clade member sequences each comprise a conserved Myb-related DNA-binding domain that is expected to function in a similar manner in each of these related sequences, that is, by playing a central role in transcriptional regulation and in the conferring of shared traits.

Experimental Observations.

Similar to G682 and other homologs of G3392, a number of G3392-overexpressing lines displayed reduced leaf trichomes and more root hairs.

On low nitrogen media, *Arabidopsis* seedlings overexpressing G3392 accumulated less anthocyanin than wild-type control seedlings. G3392 overexpressors also accumulated less anthocyanin on low nitrogen MS media minus nitrogen and supplemented with either 3% sucrose, or 3% sucrose and 1 mM glutamine, indicating an altered C/N sensing phenotype.

In heat germination assays and in assays conducted with more mature plants conducted at 32° C., G3392-overexpressing *Arabidopsis* seedlings were greener than wild-type controls. The results of this assay indicate that, similar to other members of the clade, the monocot-derived G3392 has the ability to confer tolerance to heat stress in plants.

G3392-overexpressing *Arabidopsis* plants were also more tolerant to 300 mM mannitol and 9.4% sucrose than wild-type control plants grown in plate based-assays under similar conditions, indicating a sugar-sensing and osmotic stress tolerant phenotype.

In heat germination assays and in assays conducted with more mature plants conducted in media containing 150 mM NaCl, G3392-overexpressing *Arabidopsis* seedlings were larger greener than wild-type controls.

In cold germination assays for 6 hours at 8° C. and in assays conducted with more mature plants conducted with a 6 hour exposure to 4-8° C., G3392-overexpressing *Arabidopsis* seedlings accumulated much less anthocyanin than wild-type controls. The results of this assay indicate that, similar to other members of the clade, the monocot-derived G3392 has the ability to confer tolerance to cold stress in plants.

Utilities.

The phenotypic effects of G3392 overexpression indicates that the gene or its equivalogs could be used to engineer plants with increased tolerance to several abiotic stresses and low nitrogen conditions.

G3393 (SEQ ID NO: 327 and 328)

G3393 is a rice ortholog of G682. G3393 and closely-related clade member sequences each comprise a conserved Myb-related DNA-binding domain that is expected to function in a similar manner in each of these related sequences, that is, by playing a central role in transcriptional regulation and in the conferring of shared traits.

Experimental Observations.

Similar to G682 and other homologs of G3393, a number of G3393-overexpressing lines displayed reduced leaf trichomes and more root hairs.

On low nitrogen media, *Arabidopsis* seedlings overexpressing G3393 accumulated significantly less anthocyanin than wild-type control seedlings. G3393 overexpressors also accumulated less anthocyanin on low nitrogen MS media minus nitrogen and supplemented with either 3% sucrose, or 3% sucrose and 1 mM glutamine, indicating an altered C/N sensing phenotype.

In cold germination assays for 6 hours at 8° C. and in assays conducted with more mature plants conducted with a 6 hour exposure to 4-8° C., G3393-overexpressing *Arabidopsis* seedlings accumulated much less anthocyanin than wild-type controls. The results of this assay indicate that, similar to other members of the clade, the monocot-derived G3393 has the ability to confer tolerance to cold stress in plants.

Utilities.

The phenotypic effects of G3393 overexpression indicates that the gene or its equivalogs could be used to engineer plants with increased tolerance to cold stress and low nitrogen conditions.

G3431 (SEQ ID NO: 359 and 360)

G3431 is a corn ortholog of G682. G3431 and closely-related clade member sequences each comprise a conserved Myb-related DNA-binding domain that is expected to function in a similar manner in each of these related sequences, that is, by playing a central role in transcriptional regulation and in the conferring of shared traits.

Experimental Observations.

Similar to G682 and other homologs of G3431, a number of G3431-overexpressing lines displayed reduced leaf trichomes and more root hairs.

On low nitrogen media, *Arabidopsis* seedlings overexpressing G3431 accumulated significantly less anthocyanin than wild-type control seedlings. G3431 overexpressors also accumulated less anthocyanin on low nitrogen MS media minus nitrogen and supplemented with either 3% sucrose, or 3% sucrose and 1 mM glutamine, indicating an altered C/N sensing phenotype.

In cold germination assays for 6 hours at 8° C. and in assays conducted with more mature plants conducted with a 6 hour exposure to 4-8° C., G3431-overexpressing *Arabidopsis* seedlings accumulated much less anthocyanin than wild-type controls. The results of this assay indicate that, similar to other members of the clade, the monocot-derived G3431 has the ability to confer tolerance to cold stress in plants.

In osmotic stress assays conducted on MS media containing 9.4% sucrose, G3431-overexpressing *Arabidopsis* seedlings were greener and accumulated less anthocyanin than wild-type controls, indicating osmotic stress tolerance was conferred by overexpressing G3431.

Utilities.

The phenotypic effects of G3431 overexpression indicates that the gene or its equivalogs could be used to engineer plants with increased tolerance to cold and osmotic stress and low nitrogen conditions.

G3444 (SEQ ID NO: 369 and 370)

G3444 is a corn ortholog of G682. G3444 and closely-related clade member sequences each comprise a conserved Myb-related DNA-binding domain that is expected to function in a similar manner in each of these related sequences, that is, by playing a central role in transcriptional regulation and in the conferring of shared traits.

Experimental Observations.

Similar to G682 and other homologs of G3444, a number of G3444-overexpressing lines had reduced trichomes.

On low nitrogen media, *Arabidopsis* seedlings overexpressing G3444 accumulated less anthocyanin than wild-type control seedlings. One line of G3444 overexpressors also accumulated less anthocyanin on low nitrogen MS media minus nitrogen and supplemented with either 3% sucrose, or 3% sucrose and 1 mM glutamine, indicating an altered C/N sensing phenotype.

In heat germination assays and in assays conducted with more mature plants conducted at 32° C., G3444-overexpressing *Arabidopsis* seedlings were greener than wild-type controls. The results of this assay indicate that, similar to other members of the clade, the monocot-derived G3444 has the ability to confer tolerance to abiotic stress in plants.

Utilities.

The phenotypic effects of G3444 overexpression indicates that the gene or its equivalogs could be used to engineer plants with increased tolerance to heat and low nitrogen conditions.

G3445 (SEQ ID NO: 371 and 372)

G3445 is a soy ortholog of G682. G3445 and closely-related clade member sequences each comprise a conserved Myb-related DNA-binding domain that is expected to function in a similar manner in each of these related sequences, that is, by playing a central role in transcriptional regulation and in the conferring of shared traits.

Experimental Observations.

Similar to G682 and other homologs of G3445, a number of G3445-overexpressing lines had reduced trichomes.

In germination assays conducted on media supplemented with 0.3 μM ABA, G3445-overexpressing *Arabidopsis* seedlings were larger and greener than wild-type controls.

Utilities.

The phenotypic effects of G3445 overexpression indicates that the gene or its equivalogs could be used to engineer plants with increased tolerance to osmotic stress conditions.

G3448 (SEQ ID NO: 377 and 378)

G3448 is a soy ortholog of G682. G3448 and closely-related clade member sequences each comprise a conserved Myb-related DNA-binding domain that is expected to function in a similar manner in each of these related sequences, that is, by playing a central role in transcriptional regulation and in the conferring of shared traits.

Experimental Observations.

Similar to G682 and other homologs of G3448, a number of G3448-overexpressing lines displayed reduced leaf trichomes and more root hairs.

On low nitrogen media, *Arabidopsis* seedlings overexpressing G3448 accumulated significantly less anthocyanin than wild-type control seedlings. G3448 overexpressors also accumulated less anthocyanin on low nitrogen MS media minus nitrogen and supplemented with either 3% sucrose, or 3% sucrose and 1 mM glutamine, indicating an altered C/N sensing phenotype.

In assays conducted with *Arabidopsis* plants at a 6 hour exposure to 4-8° C., G3448-overexpressing *Arabidopsis* seedlings accumulated less anthocyanin than wild-type controls. The results of this assay indicate that, similar to other members of the clade, the dicot-derived G3448 has the ability to confer tolerance to cold stress in plants.

Utilities.

The phenotypic effects of G3448 overexpression indicates that the gene or its equivalogs could be used to engineer plants with increased tolerance to cold stress and low nitrogen conditions.

G3449 (SEQ ID NO: 379 and 380)

G3449 is a soy ortholog of G682. G3449 and closely-related clade member sequences each comprise a conserved Myb-related DNA-binding domain that is expected to function in a similar manner in each of these related sequences, that is, by playing a central role in transcriptional regulation and in the conferring of shared traits.

Experimental Observations.

Similar to G682 and other homologs of G3393, a number of G3393-overexpressing lines displayed reduced leaf trichomes and more root hairs.

On low nitrogen media, *Arabidopsis* seedlings overexpressing G3449 accumulated significantly less anthocyanin than wild-type control seedlings. G3449 overexpressors also accumulated less anthocyanin on low nitrogen MS media minus nitrogen and supplemented with either 3% sucrose, or 3% sucrose and 1 mM glutamine, indicating an altered C/N sensing phenotype.

In cold germination assays for 6 hours at 8° C., G3449-overexpressing *Arabidopsis* seedlings accumulated much less anthocyanin than wild-type controls. The results of this assay indicate that, similar to other members of the clade, the dicot-derived G3449 has the ability to confer tolerance to cold stress in plants.

Utilities.

The phenotypic effects of G3449 overexpression indicates that this sequence or its equivalogs could be used to engineer plants with increased tolerance to cold stress and low nitrogen conditions.

G3450 (SEQ ID NO: 381 and 382)

G3450 is a soy ortholog of G682. G3450 and closely-related clade member sequences each comprise a conserved Myb-related DNA-binding domain that is expected to function in a similar manner in each of these related sequences, that is, by playing a central role in transcriptional regulation and in the conferring of shared traits.

Experimental Observations

Similar to G682 and other homologs of G3450, a number of G3450-overexpressing lines displayed reduced leaf trichomes and more root hairs.

On low nitrogen media, *Arabidopsis* seedlings overexpressing G3392 accumulated less anthocyanin than wild-type control seedlings. G3450 overexpressors also accumulated less anthocyanin on low nitrogen MS media minus nitrogen and supplemented with either 3% sucrose, or 3% sucrose and 1 mM glutamine, indicating an altered C/N sensing phenotype.

In cold germination assays for 6 hours at 8° C. and in assays conducted with more mature plants conducted with a 6 hour exposure to 4-8° C., G3450-overexpressing *Arabidopsis* seedlings accumulated much less anthocyanin than wild-type controls. The results of this assay indicate that, similar to other members of the clade, the dicot-derived G3450 has the ability to confer tolerance to cold stress in plants.

In heat germination assays and in assays conducted with more mature plants conducted at 32° C., G3450-overexpressing *Arabidopsis* seedlings were greener than wild-type controls. The results of this assay indicate that, similar to other members of the clade, the dicot-derived G3450 has the ability to confer tolerance to heat stress in plants.

G3450-overexpressing *Arabidopsis* plants were also more tolerant to salt and desiccation than wild-type control plants grown under similar conditions in plate based-assays, and to drought conditions in soil-based assays.

Utilities.

The phenotypic effects of G3450 overexpression indicates that this sequence or its equivalogs could be used to engineer plants with increased tolerance to low nitrogen conditions, salt, cold stress, heat stress, and low water conditions.

The G24 Clade of Transcription Factor Polypeptides
G24 (SEQ ID NO: 419 and 420)

G24 corresponds to gene At2g23340 (AAB87098). G24 and closely-related clade member sequences each comprise a conserved AP2 DNA-binding domain that is expected to function in a similar manner in each of these related sequences, that is, by playing a central role in transcriptional regulation and in the conferring of shared traits.

Experimental Observations.

Based on RT-PCR expression analysis, G24 was found to be ubiquitously expressed at low levels in germinating seedlings. The function of G24 was studied using transgenic plants in which the gene was expressed under the control of the 35S promoter. 35S::G24 seedlings often developed black necrotic tissue patches on cotyledons and leaves, and many died at that stage. Some 35S::G24 seedlings exhibited a weaker phenotype, and although necrotic patches were visible on the cotyledons, they did not die. These seedlings developed into plants that were usually small, slow growing, and poorly fertile in comparison to wild type controls. The leaves of older 35S::G24 plants were also observed to become yellow and senesce prematurely compared to wild type. Of the lines sent for physiological assays, all showed a comparable response to wild-type. However, 35S::G24 line 2 seedlings became necrotic and died immediately after germination on MS plates. 35S::G24 line 8 has an intermediate phenotype in which the seedlings develop some necrotic lesions but survived and 35S::G24 line 11 seedlings appeared wild-type.

We have now analyzed 35S::G24 seedlings in a C/N sensing assay. Anthocyanin accumulation was slightly less than that observed in control wild-type seedlings (Table 14), indicating that the gene may be involved in the response to low nutrient conditions.

Utilities.

These assays indicate that G24 and its equivalogs are potential regulators of a plant's response to low nutrient conditions. For further analysis, see the discussion above: "Potential Applications of Polynucleotides and Polypeptides that Regulate C/N sensing".

The G154 Clade of Transcription Factor Polypeptides
G154 (SEQ ID NO: 421 and 422)

G154 was identified in the sequence of BAC F17K2, from chromosome 2 (gene At2g45660). It also corresponds to SUPPRESSOR OF OVEREXPRESSION OF CO (SOC1), and was previously designated AGL20 (Samach et al. (2000) *Science.* 288: 1613-1616; Lee et al. (2000) *Genes Dev.* 14:2366-2376; Borner et al. (2000) *Plant J.* 24: 591-599). This gene has been isolated several times in genetic and molecular screens for flowering-time mutants. SOC1/AGL20 was identified by suppression subtraction hybridization as a direct target of the zinc finger transcription factor CONSTANS (Samach et al. (2000) supra), and also genetically as a late flowering mutant capable of suppressing the phenotype caused by overexpression of CO (hence the name SOC1) (Onouchi et al. (2000) *Plant Cell* 12: 885-900). The gene was also identified as a dominant FRIGIDA (FRI) suppressor in activation tagging mutagenesis (Lee et al. (2000) supra), as well as a late flowering mutant generated by transposon tagging (Borner et al. (2000) supra). Genetic and molecular analyses have allowed the position of this gene within the flowering-time control network to be determined.

Samach et al. (Samach et al. (2000) supra) reported that flowering is triggered by endogenous and environmental signals. CO promotes flowering of *Arabidopsis* in response to day length. Early target genes of CO were identified using a steroid-inducible version of the protein. Two of these genes, SOC1 and FLOWERING LOCUS T (FT), are required for CO to promote flowering. SOC1 and FT are also regulated by a second flowering-time pathway that acts independently of CO. Thus, early target genes of CO define common components of distinct flowering-time pathways.

Lee et al. (Lee (2000) supra) reported that the very late-flowering behavior of *Arabidopsis* winter-annual ecotypes is conferred mainly by two genes, FRI and FLOWERING LOCUS C (FLC). AGL20 was identified as a dominant FRI suppressor in activation tagging mutagenesis. Overexpression of AGL20 suppresses not only the late flowering of plants that have functional FRI and FLC alleles but also the delayed phase transitions during the vegetative stages of plant development. Interestingly, AGL20 expression is positively regulated not only by the redundant vernalization and autonomous pathways of flowering but also by the photoperiod pathway. Our results indicate that AGL20 is an important integrator of three pathways controlling flowering in *Arabidopsis*.

Borner et al. (Borner et al. (2000) supra) reported that the flowering time in many plants is triggered by environmental factors that lead to uniform flowering in plant populations, ensuring higher reproductive success. So far, several genes have been identified that are involved in flowering time control. AGL20 is activated in shoot apical meristems during the transition to flowering. By transposon tagging we have identified late flowering agl20 mutants, showing that AGL20 is involved in flowering time control. In previously described late flowering mutants of the long-day and constitutive pathways of floral induction the expression of AGL20 is down-regulated, demonstrating that AGL20 acts downstream to the mutated genes. Moreover, we can show that AGL20 is also regulated by the gibberellin (GA) pathway, indicating that AGL20 integrates signals of different pathways of floral induction and might be a central component for the induction of flowering. In addition, the constitutive expression of AGL20 in *Arabidopsis* is sufficient for photoperiod independent flowering and the over-expression of the orthologous gene from mustard, MADSA, in the classical short-day tobacco Maryland Mammoth bypasses the strict photoperiodic control of flowering.

G154 and closely-related clade member sequences each comprise a conserved MADS DNA-binding domain that is expected to function in a similar manner in each of these related sequences, that is, by playing a central role in transcriptional regulation and in the conferring of shared traits.

Experimental Observations.

The function of G154 was studied using transgenic plants in which the gene was expressed under the control of the 35S promoter. Overexpression of G154 produced a range of morphological effects. Early flowering was noted in a small number of primary transformants. Additionally, 35S::G154 lines were sometimes small, spindly and poorly fertile. G154 overexpressing lines behave similarly to wild-type controls in all physiological and biochemical assays performed.

SOC1 has a well-established role in regulation of the onset of flowering. We have now analyzed 35S::G154 seedlings in a C/N sensing assay. Anthocyanin accumulation was slightly less than that observed in control wild-type seedlings in all three lines tested (Table 14). Thus, in addition to its effects on flowering time, this gene might also influence the response to low nutrient conditions.

Utilities.

These assays indicate that G154 and its equivalogs are potential regulators of a plant's response to low nutrient conditions. For further analysis, see the discussion above: "Potential Applications of Polynucleotides and Polypeptides that Regulate C/N sensing".

The G384 Clade of Transcription Factor Polypeptides
G384 (SEQ ID NO: 423 and 424)

G384, also called ATML1 (Lu et al. (1996) *Plant Cell* 8:2155-2168), belongs to the HD-GL2 class of homeodomain proteins. It was isolated based on its homology to O39, a homeodomain protein from orchid. Northern blot analysis indicated that it was floral bud specific in *Arabidopsis* and in situ hybridization data showed that G384 was only expressed in the L1 layer of the shoot meristems and the protoderms of the pre-torpedo stage embryos. G384 and closely-related clade member sequences each comprise a conserved homebox DNA binding domain (or "homeodomain") and a START domain that are expected to function in a similar manner in each of these related sequences, that is, by playing a central role in transcriptional regulation and in the conferring of shared traits.

Experimental Observations.

35S::G384 lines showed developmental abnormalities including fused organs. We have now analyzed the function of G384 by characterizing overexpression lines in C/N sensing assays. These lines showed increased sensitivity and elevated anthocyanin levels relative to wild-type (Table 14). It is possible, however, that G384 is not specifically involved in a C/N sensing response since addition of glutamine to the growth plates did not alleviate the phenotype. It should be emphasized that G384 is a member of the HD-GL2 class of homeodomain proteins. Overexpression lines for two other HD-GL2 class genes, G1535 and G707, showed comparable phenotypes to the 35S::G384 lines studied in the present screen. These findings are of particular interest because GL2 acts in the genetic pathway through which the CAPRICE (CPC) related genes regulate root development. The current results indicate that as well as GL2 itself, other homeodomain proteins from the HD-GL2 class might also act in pathways involving the CAPRICE (CPC) related genes, given that the CAPRICE (CPC) related genes influence nutrient limitation responses and anthocyanin production.

Utilities.

These assays indicate that G384 and its equivalogs are potential regulators of a plant's response to low nutrient conditions. For further analysis, see the discussion above: "Potential Applications of Polynucleotides and Polypeptides that Regulate C/N sensing".

The G486 Clade of Transcription Factor Polypeptides
G486 (SEQ ID NO: 293 and 294)

G486 was identified as a BAC sequence (AC000106) with homology to CCAAT-like transcription factors. G486 and closely-related clade member sequences each comprise a conserved CBFD_NFYB_HMF domain that is expected to function in a similar manner in each of these related sequences, that is, by playing a central role in transcriptional regulation and in the conferring of shared traits.

Experimental Observations.

RT-PCR expression analysis indicated that G486 is expressed primarily in roots, flowers, cauline leaves and seedlings. The function of G486 was analyzed through by the generation of 35S::G486 overexpressing plants. 35S::G486 lines were noted to be somewhat small, rather darker green, and were delayed in the onset of flowering.

We have now analyzed 35S::G486 seedlings in a C/N sensing assay. Anthocyanin accumulation was less than that observed in control wild-type seedlings in one line of two lines tested, indicating that overexpression of G486 in *Arabidopsis* gave a mild response in overcoming the stress caused by this assay (Table 14).

Utilities.

These assays indicate that G486 and its equivalogs are potential regulators of a plant's response to low nutrient conditions. For further analysis, see the discussion above: "Potential Applications of Polynucleotides and Polypeptides that Regulate C/N sensing".

The G545 Clade of Transcription Factor Polypeptides
G545 (SEQ ID NO: 425 and 426)

G545 was discovered independently by two groups. Lippuner et al. (Lippuner et al. (1996) *J. Biol. Chem.* 271: 12859-2866) identified G545 as an *Arabidopsis* cDNA (STZ), which increases the tolerance of yeast to Li+ and Na+. They found that STZ expression is most abundant in leaves and roots, and that its level of expression increases slightly upon exposure of the plant to salt. The second group (Meissner and Michael (1997) *Plant Mol. Biol.* 33:615-624), identified G545 (ZAT10) in a group of *Arabidopsis* C2H2 zinc finger protein-encoding cDNAs that they isolated by degenerate PCR. According to their data, ZAT10 is expressed in roots, shoots and stems. G545 and closely-related clade member sequences each comprise a conserved C2H2 DNA-binding zinc finger domain that is expected to function in a similar manner in each of these related sequences, that is, by playing a central role in transcriptional regulation and in the conferring of shared traits.

Experimental Observations.

Plants overexpressing G545 were smaller than wild type plants, flowered early, and in extreme cases were infertile. G545 overexpression conferred tolerance to phosphate deficiency. However, the small size of the seedlings made it difficult to make root growth comparisons with wild type. 35S::G545 lines also appeared more sensitive to NaCl than wild type plants. Finally, G545 overexpressing plants appeared to be significantly more susceptible to pathogens than control plants.

We have now analyzed the function of G545 by characterizing 35S:G545 overexpressing lines in a C/N sensing assay. Anthocyanin accumulation was elevated compared to control wild-type seedlings (Table 14). Thus, the gene could have a role in the response to nutrient limitation or abiotic stress.

Utilities.

The first useful phenotype G545 overexpressors are displaying is their tolerance to phosphate deficiency. Young plants have a rapid intake of phosphorous, so it is important that seed beds have high enough content in phosphate to sustain their growth. Also, root crops such as carrot, potato and parsnip will all decrease in yield if there is insufficient phosphate available. Phosphate costs represent a relatively small but significant portion of farmers' operating costs (3-4% of total costs to a corn farmer in the US, higher to a vegetable grower). Plants that are tolerant to phosphate deficiency can represent a cost saving for farmers, especially in areas where soils are very poor in phosphate.

Another desirable phenotype, salt tolerance, may arise from G545 silencing rather than overexpression. Additionally, G545 appears to be induced by cold, drought, salt and osmotic stresses, which is in agreement with a potential role of the genes in protecting the plant in such adverse environmental conditions.

G545 appears to be involved in the control of defense processes. However, overexpression of G545 made *Arabidopsis* plants more susceptible to disease. This negative effect will have to be corrected before G545 can be used in a crop to induce tolerance to low phosphate. One example of a method to approach the problem would be to restrict overexpression of G545 to roots.

These assays indicate that G545 and its equivalogs are potential regulators of a plant's response to low nutrient conditions. For further analysis, see the discussion above: "Potential Applications of Polynucleotides and Polypeptides that Regulate C/N sensing".

The G760 Clade of Transcription Factor Polypeptides
G760 (SEQ ID NO: 427 and 428)

G760 corresponds to the gene NAC2, GenBank accession no. AF201456. G760 was found to be highly expressed in root meristems. G760 and closely-related clade member sequences each comprise a conserved NAC domain that is expected to function in a similar manner in each of these related sequences, that is, by playing a central role in transcriptional regulation and in the conferring of shared traits.

Experimental Observations.

RT-PCR analysis demonstrated that G760 was uniformly expressed in all tissues and under all conditions. The function of G760 gene was analyzed using transgenic plants in which the gene was expressed under the control of the 35S promoter. Many 35S::G760 primary transformants were small and had rather curled, twisted, leaves. However, T2 populations all showed a wild-type phenotype, indicating that activity of the transgene might have been reduced between the generations. In addition, overexpression of G760 in *Arabidopsis* resulted in T2 seedlings that were hypersensitive to growth on ACC.

We have now analyzed the function of G760 by characterizing 35S:G760 overexpressing lines in a C/N sensing assay. Anthocyanin accumulation was greatly elevated compared to that observed in control wild-type seedlings in one of three lines tested (Table 14). Thus, G760 could have a role in response to low nutrient conditions.

Utilities.

G760 could be used to manipulate ethylene signal transduction or response pathways. The gene could be used to manipulate the processes influenced by ethylene, such as fruit ripening.

These assays indicate that G760 and its equivalogs are potential regulators of a plant's response to low nutrient conditions. For further analysis, see the discussion above: "Potential Applications of Polynucleotides and Polypeptides that Regulate C/N sensing".

The G773 Clade of Transcription Factor Polypeptides
G773 (SEQ ID NO: 429 and 430)

G773 (AT3G15500) in the sequence of GenBank accession number AB022218, released by the *Arabidopsis* Genome Initiative and corresponds to AtNAC3 (Takada et al. (2001) *Development* 128:1127-1135). G773 and closely-related clade member sequences each comprise a conserved NAC domain that is expected to function in a similar manner in each of these related sequences, that is, by playing a central role in transcriptional regulation and in the conferring of shared traits.

Experimental Observations.

RT-PCR analysis determined that G773 has the highest levels of expression in roots, flowers and embryos and is expressed at medium or low levels in rosettes, siliques and seedlings. RT-PCR data also indicated a significant induction of G773 transcripts accumulation upon auxin, heat, osmotic, drought and *Fusarium* treatments. The phenotype of the transgenic lines analyzed was wild type in all assays performed at that time.

We have now analyzed the function of G773 by characterizing 35S::G773 overexpressing lines in a C/N sensing assay. Anthocyanin accumulation was elevated compared to that observed in wild-type seedlings (Table 14). Thus, G773 could have a role in the response to nutrient limitation Utilities.

These assays indicate that G773 and its equivalogs are potential regulators of a plant's response to low nutrient conditions. For further analysis, see the discussion above: "Potential Applications of Polynucleotides and Polypeptides that Regulate C/N sensing".

The G937 Clade of Transcription Factor Polypeptides
G937 (SEQ ID NO: 431 and 432)

G937 (AT1G49560) was initially identified in the sequence of BAC F14J22 (GenBank accession AC011807) released by the *Arabidopsis* Genome Initiative. G937 and closely-related clade member sequences each comprise a conserved GARP DNA-binding domain that is expected to function in a similar manner in each of these related sequences, that is, by playing a central role in transcriptional regulation and in the conferring of shared traits.

Experimental Observations.

RT-PCR expression analysis demonstrated that G937 was expressed at relatively high levels throughout the plant, and was not induced by any condition tested. The function of this gene was analyzed using transgenic plants in which G937 was expressed under the control of the 35S promoter. The majority of 35S::G937 primary transformants were smaller than wild type, slightly slow developing, and produced thin inflorescence stems that carried relatively few siliques.

We have now analyzed 35S::G937 seedlings in a C/N sensing assay. Anthocyanin accumulation was less than that observed in control wild-type seedlings in one of three lines tested (Table 14). Thus, G937 might have a role in the response to nutrient limitation Utilities.

G937 may be useful for regulation of plant growth and development.

These assays indicate that G937 and its equivalogs are potential regulators of a plant's response to low nutrient conditions. For further analysis, see the discussion above: "Potential Applications of Polynucleotides and Polypeptides that Regulate C/N sensing".

The G971 Clade of Transcription Factor Polypeptides
G971 (SEQ ID NO: 433 and 434)

G971 (AT3G54990) corresponds to gene F28P10.30 (GenBank accession CAB41085). G971 and closely-related clade member sequences each comprise a conserved AP2 DNA-binding domain that is expected to function in a similar manner in each of these related sequences, that is, by playing a central role in transcriptional regulation and in the conferring of shared traits.

Experimental Observations.

RT-PCR expression analysis indicated that G971 is ubiquitously expressed. The function of G971 was studied using transgenic plants in which the gene was expressed under the control of the 35S promoter. Overexpression of G971 produced a marked delay in the transition to flowering. No obvious phenotype was observed during that period with 35S::G971 plants in physiological assays.

We have now analyzed the function of G971 by characterizing 35S:G971 overexpressing lines in a C/N sensing assay. Anthocyanin accumulation was elevated compared to the levels seen in control wild-type seedlings (Table 14). Thus, G971 could have a role in the response to low nitrogen conditions.

Utilities.

G971 could be used to modify flowering time characteristics.

These assays indicate that G971 and its equivalogs are potential regulators of a plant's response to low nutrient conditions. For further analysis, see the discussion above: "Potential Applications of Polynucleotides and Polypeptides that Regulate C/N sensing".

The G988 Clade of Transcription Factor Polypeptides
G988 (SEQ ID NO: 435 and 436)

G988 (AT1G55580) corresponds to a protein annotated as hypothetical in BAC F20N2 (GenBank accession number AC002328) from chromosome 1 of *Arabidopsis*. The sequence for G988 is described in patent application WO 9846759. G988 and closely-related clade member sequences each comprise a conserved SCR domain that is expected to function in a similar manner in each of these related sequences, that is, by playing a central role in transcriptional regulation and in the conferring of shared traits.

Experimental Observations.

RT-PCR expression analysis indicated that G988 appears to be expressed primarily in flower and silique tissue and is induced in response to heat treatment. The function of this gene was analyzed using transgenic plants in which G988 was expressed under the control of the 35S promoter. Plants overexpressing G988 had multiple morphological phenotypes. The transgenic plants were generally smaller than wild-type plants, had altered leaf, inflorescence and flower development, altered plant architecture, and altered vasculature.

We have now analyzed the function of G988 by characterizing 35S::G988 overexpressing lines in a C/N sensing assay. Anthocyanin accumulation was elevated compared to that observed in control wild-type seedlings (Table 14). Thus, G988 could have a role in the response to low nitrogen conditions.

Utilities.

Based on the observed morphological phenotypes of the transgenic plants, it is possible that G988 could be used to create plants with larger flowers. This could have potential value in the ornamental horticulture industry. The reduction in the formation of lateral branches indicates that G988 could have possible utility on the forestry industry. The *Arabidopsis* plants overexpressing G988 also had reduced fertility. This could actually be a desirable trait in some instances, as it could be exploited to prevent or minimize the escape of GMO pollen into the environment.

These assays indicate that G988 and its equivalogs are potential regulators of a plant's response to low nutrient conditions. For further analysis, see the discussion above: "Potential Applications of Polynucleotides and Polypeptides that Regulate C/N sensing".

The G989 Clade of Transcription Factor Polypeptides
G989 (SEQ ID NO: 437 and 438)

G989 (AT5G41920) corresponds to a predicted SCARECROW gene regulator-like protein in annotated P1 clone (GenBank accession AB017067). G989 and closely-related clade member sequences each comprise a conserved SCR domain that is expected to function in a similar manner in each of these related sequences, that is, by playing a central role in transcriptional regulation and in the conferring of shared traits.

Experimental Observations.

RT-PCR expression analysis indicated that G989 appeared to be expressed at highest levels in embryo tissue, and at low levels in all other tissues tested. Expression of G989 appeared to be induced in response to treatment with auxin, ABA, heat and drought, and to a lesser extent in response to salt treatment and osmotic stress. The function of this gene was also analyzed using transgenic plants in which G989 was expressed under the control of the 35S promoter. Plants overexpressing G989 appeared to be somewhat early flowering, but in other respects appeared normal, and showed a wild-type response in the physiological assays performed at that time.

We have now analyzed 35S::G989 seedlings in a C/N sensing assay. Anthocyanin accumulation was slightly less than that observed in control wild-type seedlings (Table 14), indicating that G989 has a role in the response to nutrient limitation.

Utilities.

If the early flowering phenotype is reproducible in a larger number of plants and under a wider range of environmental conditions, it is possible that G989 could be used to alter flowering time in other plant species. A number of *Arabidopsis* genes have already been shown to accelerate flowering when constitutively expressed. These include LEAFY, APETALA1 and CONSTANS. In these cases, however, the early flowering plants showed undesirable side effects such as extreme dwarfing, infertility, or premature termination of shoot meristem growth (Mandel and Yanofsky (1995) *Nature* 377: 522-524, Weigel and Nilsson (1995) *Nature* 377: 495-500, Simon et al. (1996). 384: *Nature* 59-62). Our initial study indicates that G989 can induce flowering without these toxic pleiotropic effects.

These assays indicate that G989 and its equivalogs are potential regulators of a plant's response to low nutrient conditions. For further analysis, see the discussion above: "Potential Applications of Polynucleotides and Polypeptides that Regulate C/N sensing".

The G1073 Clade of Transcription Factor Polypeptides
G1069 (SEQ ID NO: 239 and 240)

G1069 is a paralog of G1073 from *Arabidopsis*. G1069 corresponds to AT4G14465 and is a member of the AT-Hook related proteins in *Arabidopsis*. G1069 and closely-related clade member sequences each comprise a conserved At-hook domain and a second conserved domain (amino acids 76-218) or the DUF296 domain (amino acids 93-211) that are expected to function in a similar manner in each of these related sequences, that is, by playing a central role in transcriptional regulation and in the conferring of shared traits.

Experimental Observations.

G1069 was predominantly expressed in roots, based our initial analysis of RT-PCR results. The function of G1069 was analyzed using transgenic plants in which G1069 was expressed under the control of the 35S promoter. Plants overexpressing G1069 showed changes in leaf architecture, reduced overall plant size, and retarded progression through the life cycle. One G1069 overexpressing line showed more tolerance to abiotic stress when they were germinated in high sucrose plates. This line (line 41) also showed insensitivity to ABA in a germination assay. Moreover, seedlings of this line also look smaller and chlorotic in control germination plates.

We have now analyzed 35S::G1069 seedlings in a C/N sensing assay. Anthocyanin accumulation was slightly less than that observed in control wild-type seedlings in one line (line 41) (Table 14), indicating that overexpression of G1069 in *Arabidopsis* gave a very mild response in overcoming the stress caused by this assay. The other two lines were wild type. Line 41 also gave a positive stress phenotype when germinated on media containing sucrose and ABA.

Utilities.

Because of its effect on leaf architecture, plant size and plant development, G1069 may have some utility in modifying plant growth and development. In addition, the promoter of G1069 may have some utility as a promoter that is active in roots.

These assays indicate that G1069 and its equivalogs are potential regulators of a plant's response to low nutrient conditions. For further analysis, see the discussion above: "Potential Applications of Polynucleotides and Polypeptides that Regulate C/N sensing".

G2789 (SEQ ID NO: 247 and 248)

The sequence of G2789 (AT3G60870) was obtained from the *Arabidopsis* genomic sequencing project, GenBank accession number AL162295, based on its sequence similarity to other AT-hook related proteins. G2789 is a sequence functionally and structurally related to G1073 from *Arabidopsis*. G2789 and closely-related clade member sequences each comprise a conserved At-hook domain and a second conserved domain (amino acids 68-208) or the DUF296 domain (amino acids 86-201) that are expected to function in a similar manner in each of these related sequences, that is, by playing a central role in transcriptional regulation and in the conferring of shared traits.

Experimental Observations.

RT-PCR analysis indicated that G2789 is expressed at moderate levels in roots, flowers, embryos, siliques, and germinating seeds. At this time, G2789 function was analyzed using 35S::G2789 lines. Overexpression of G2789 in *Arabidopsis* resulted in seedlings that were ABA insensitive and abiotic stress tolerant. Overexpression of G2789 also produced alterations in leaf and flower development, and caused severe reductions in fertility. 35S::G2789 primary transformants displayed a variety of leaf abnormalities including; leaf curling, serrations, and changes in leaf shape and area.

We have now analyzed 35S::G2789 seedlings in a C/N sensing assay. Anthocyanin accumulation was significantly less than that observed in control wild-type seedlings (Table 14). Thus, the gene might have a role in nutrient limitation responses. However, because the C/N sensing assay has high levels of sucrose, the enhanced vigor of seedlings seen in this assay could be related to the enhanced abiotic stress previously observed. It remains to be determined whether the effects seen in this assay are related to the apparent involvement of the gene in shade tolerance Utilities.

G2789 could be used to alter a plant's response to water deficit conditions and therefore, could be used to engineer plants with enhanced tolerance to drought, salt stress, and freezing.

These assays also indicate that G2789 and its equivalogs are potential regulators of a plant's response to low nutrient conditions. For further analysis, see the discussion above: "Potential Applications of Polynucleotides and Polypeptides that Regulate C/N sensing".

The G1090 Clade of Transcription Factor Polypeptides

G1090 (SEQ ID NO: 439 and 440)

Experimental Observations.

In a C/N sensing assay anthocyanin accumulation was slightly less in G1090 seedlings than that observed in control wild-type seedlings in one of three lines tested (Table 14), indicating that overexpression of G1090 in *Arabidopsis* gives a mild response in overcoming the stress caused by this assay. G1090 and closely-related clade member sequences each comprise a conserved AP2 DNA binding domain that is expected to function in a similar manner in each of these related sequences, that is, by playing a central role in transcriptional regulation and in the conferring of shared traits.

Utilities.

These assays indicate that G1090 and its equivalogs are potential regulators of a plant's response to low nutrient conditions. For further analysis, see the discussion above: "Potential Applications of Polynucleotides and Polypeptides that Regulate C/N sensing".

The G1322 Clade of Transcription Factor Polypeptides

G1322 (SEQ ID NO: 441 and 442)

G1322 is a member of the (R1)R2R3 subfamily of myb transcription factors. G1322 corresponds to Myb57, a gene identified by Kranz et al. (1998) *Plant J.* 16: 263-276). The authors used a reverse-Northern blot technique to study the expression of this gene in a variety of tissues and under a variety of environmental conditions. They were unable to detect the expression of G1322 in any tissue or treatments tested (Kranz et al (1998) supra). G1322 and closely-related clade member sequences each comprise a conserved MYB_related DNA-binding domain that is expected to function in a similar manner in each of these related sequences, that is, by playing a central role in transcriptional regulation and in the conferring of shared traits.

Experimental Observations.

RT-PCR analysis indicated that G1322 is expressed primarily in flower tissue and is not induced in response to any environmental stress-related condition tested. At that time, the function of G1322 was analyzed using transgenic plants in which the gene was expressed under the control of the 35S promoter. 35S::G1322 transgenic plants had changes in overall plant size and leaf development. 35S::G1322 plants were distinctly smaller than controls and developed curled dark-green leaves. Following the switch to flowering, the plants formed relatively thin inflorescence stems and had a rather poor seed yield. In addition, overexpression of G1322 resulted in plants with an altered etiolation response as well as enhanced tolerance to germination under chilling conditions.

We have now analyzed 35S::G1322 seedlings in a C/N sensing assay. Anthocyanin accumulation was significantly less than that observed in control wild-type seedlings in one of three lines examined (Table 14), indicating that the gene may play a role in the response to low nutrient conditions.

Utilities.

The potential utilities of G1322 include altering a plant's chilling sensitivity and altering a plant's light response.

These assays indicate that G1322 and its equivalogs are potential regulators of a plant's response to low nutrient conditions. For further analysis, see the discussion above: "Potential Applications of Polynucleotides and Polypeptides that Regulate C/N sensing".

The G1587 Clade of Transcription Factor Polypeptides
G1587 (SEQ ID NO: 443 and 444)

G1587 (AT2G01500) was originally identified as a novel homeobox gene within BAC F219 (GenBank accession AC005560). G1587 and closely-related clade member sequences each comprise a conserved homeobox domain that is expected to function in a similar manner in each of these related sequences, that is, by playing a central role in transcriptional regulation and in the conferring of shared traits.

Experimental Observations.

RT-PCR experiments revealed that the gene is predominantly expressed in flowers. At that time, the function of G1587 was assessed by analysis of transgenic *Arabidopsis* lines in which the cDNA was constitutively expressed from the 35S CaMV promoter. However, overexpression of G1587 produced deleterious effects on growth and development. The most severely affected 35S::G1587 primary transformants died at very early stages of development. Other seedlings, however, displayed rather contorted cotyledons, long hypocotyls, and produced small narrow dark green leaves. Following the switch to flowering, such plants formed rather thin inflorescence stems that carried somewhat small numbers of flowers. Floral organs were often contorted or poorly developed, and as a result, seed yield was poor. The three lines used for physiological analysis showed a relatively weak phenotype.

We have now analyzed 35S::G1587 seedlings in a C/N sensing assay. Anthocyanin accumulation was slightly less than that observed in control wild-type seedlings in all three of the lines examined (Table 14), indicating that the gene may play a role in the response to low nutrient conditions.

Utilities.

The RT-PCR data indicates that the G1587 promoter might be of utility for driving expression of transgenes within flowers. Additionally, if future studies confirm that G1587 has a function in the regulation of flower development, the gene might be used to manipulate those structures.

These assays indicate that G1587 and its equivalogs are potential regulators of a plant's response to low nutrient conditions. For further analysis, see the discussion above: "Potential Applications of Polynucleotides and Polypeptides that Regulate C/N sensing".

The G1666 Clade of Transcription Factor Polypeptides
G1666 (SEQ ID NO: 445 and 446)

The sequence of G1666 was obtained from the *Arabidopsis* genome sequencing project, GenBank accession number AL049482, based on its sequence similarity within the conserved domain to other HLH/MYC related proteins in *Arabidopsis*. G1666 has been recently identified as TT8 from a T-DNA mutagenized *Arabidopsis* collection (Nesi et al. (2000) *Plant Cell*. 12:1863-1878). G1666 and closely-related clade member sequences each comprise a conserved HLH DNA-binding and dimerization domain that is expected to function in a similar manner in each of these related sequences, that is, by playing a central role in transcriptional regulation and in the conferring of shared traits.

It has been shown that G1666/TT8 is involved in the regulation of flavonoid biosynthesis in the *Arabidopsis* seed coat. The protein is required for normal expression of two flavonoid biosynthetic genes, DFR and BAN. G1666 transcripts accumulate more in developing siliques and in young seedlings compared to other tissues.

Experimental Observations,

RT-PCR expression analysis indicated that G1666 was predominantly expressed in reproductive tissue such as embryo, siliques and flowers. At that time, the function of G1666 was analyzed using a line homozygous for a T-DNA insertion in the gene and transgenic plants in which the gene was expressed under the control of the 35S promoter. Plants homozygous for a T-DNA insertion within G1666 produced yellow seed. However, at all other developmental stages, these plants appeared wild type. G1666 knockout mutant seedlings responded differently in an ethylene insensitivity assay compared to the wild-type controls. Seedlings germinated in the dark on ACC-containing media are more severely stunted than the wild-type controls. 35S::G1666 plants were wild type in all assays performed.

We have now analyzed the function of G1666 by characterizing a line homozygous for a T-DNA insertion in G1666 in a C/N sensing assay. Anthocyanin accumulation was slightly less than that observed in control wild-type seedlings in knocked-out G1666 lines (Table 14), indicating that the gene might have a role in the response to nutrient limitation. However the lack of anthocyanin production observed in this assay could be related to the block in flavonoid biosynthesis caused by the T-DNA insertion within G1666.

Utilities.

Because expression of G1666 is flower, embryo and silique specific, its promoter could be useful for targeted gene expression in these organs.

Co-overexpression of G1666 with G669, and G663 could be used to increase the production of flavonoid compounds, including anthocyanins and condensed tannins, in *Arabidopsis*. The potential utilities of this gene include alterations in pigment production for horticultural purposes, and possibly increasing stress resistance in combination with another transcription factor. Flavonoids have antimicrobial activity and could be used to engineer pathogen resistance. Several flavonoid compounds have health promoting effects such as the inhibition of tumor growth and cancer, prevention of bone loss and the prevention of the oxidation of lipids. Increasing levels of condensed tannins, whose biosynthetic pathway is shared with anthocyanin biosynthesis, in forage legumes is an important agronomic trait because they prevent pasture bloat by collapsing protein foams within the rumen.

These assays indicate that G1666 and its equivalogs are potential regulators of a plant's response to low nutrient conditions. For further analysis, see the discussion above: "Potential Applications of Polynucleotides and Polypeptides that Regulate C/N sensing".

The G1700 Clade of Transcription Factor Polypeptides
G1700 (SEQ ID NO: 447 and 448)

G1700 (AT4G10150), a member of the RING C3H2C3 gene family, was identified in the sequence of BAC T9A4 (GenBank accession AF096373), released by the *Arabidopsis* Genome Initiative. G1700 and closely-related clade member sequences each comprise a conserved homeobox and RING finger domain that is expected to function in a similar manner in each of these related sequences, that is, by playing a central role in transcriptional regulation and in the conferring of shared traits.

Experimental Observations.

RT-PCR expression analysis indicated that G1700 was highly expressed in embryos. No expression in any other tissue was detected at that time. A line homozygous for a T-DNA insertion in G1700 was used to determine the function of this gene. The phenotype of G1700 knock-out plants was wild type in all assays performed.

We have now analyzed the function of G1700 by characterizing a line homozygous for a T-DNA insertion in G1700 in a C/N sensing assay. Anthocyanin accumulation was slightly less than that observed in control wild-type seedlings (Table 14), indicating that the gene might have a role in the response to low nutrient conditions.

Utilities.

The strong expression in embryos indicates that the promoter of G1700 could be used to drive embryo specific expression.

These assays indicate that G1700 and its equivalogs are potential regulators of a plant's response to low nutrient conditions. For further analysis, see the discussion above: "Potential Applications of Polynucleotides and Polypeptides that Regulate C/N sensing".

HAP5 Transcription Factor Polypeptides

G1818 (SEQ ID NO: 449 and 450)

G1818 (AT5G50490), a member of the Hap5-like subfamily of CCAAT-box binding transcription factors, was identified in the sequence of P1 clone MBA10 (GenBank accession AB025619). G1818 and closely-related clade member sequences each comprise a conserved CCAAT binding factor domain that is expected to function in a similar manner in each of these related sequences, that is, by playing a central role in transcriptional regulation and in the conferring of shared traits.

Experimental Observations.

RT-PCR expression analysis indicated that G1818 expression was detected in embryos, flowers and siliques. Expression of G1818 could also be detected in leaf tissue following cold and auxin treatments. At that time, the function of this gene was analyzed using transgenic plants in which G1818 was expressed under the control of the 35S promoter. With the exception of delayed flowering and subtle changes in leaf morphology (flatter leaves), the phenotype of these transgenic plants was wild-type in all assays performed.

We have now analyzed 35S::G1818 seedlings in a C/N sensing assay. Anthocyanin accumulation was substantially lower than that observed in control wild-type seedlings (Table 14), indicating that G1818 plays a role in the response to low nutrient conditions.

Utilities.

G1818 could be used to delay flowering in plants, which may extend vegetative development and bring about larger yields.

These assays indicate that G1818 and its equivalogs are potential regulators of a plant's response to low nutrient conditions. For further analysis, see the discussion above: "Potential Applications of Polynucleotides and Polypeptides that Regulate C/N sensing".

The G1868 Clade of Transcription Factor Polypeptides

G1868 (SEQ ID NO: 451 and 452)

G1868 (AT4G37740) was found in the sequence of BAC clone T28119 (GenBank accession AL035709) based on its amino acid sequence similarity to the rice Growth-regulating-factorl (GRF1). G1868 and closely-related clade member sequences each comprise a QRQ and WRC conserved domain that are expected to function in a similar manner in each of these related sequences, that is, by playing a central role in transcriptional regulation and in the conferring of shared traits.

Experimental Observations.

RT-PCR expression analysis revealed a constitutive expression in all tissues except roots. At this time, the function of G1868 was analyzed through its ectopic overexpression in plants. No apparent changes were apparent when compared to control plants.

We have now analyzed 35S::G1868 seedlings in a C/N sensing assay. Anthocyanin accumulation was slightly less than that observed in control wild-type seedlings in two lines (Table 14), indicating that G1868 might have a minor role in the response to low nutrient conditions.

Utilities.

These assays indicate that G1868 and its equivalogs are potential regulators of a plant's response to low nutrient conditions. For further analysis, see the discussion above: "Potential Applications of Polynucleotides and Polypeptides that Regulate C/N sensing".

The G1888 Clade of Transcription Factor Polypeptides

G1888 (SEQ ID NO: 453 and 454)

G1888 (AT4G39070) was identified in the sequence of BAC accession number AL035679, released by the Arabidopsis Genome Initiative and is a member of the Z-CO-like transcription factor family. G1888 and closely-related clade member sequences each comprise at least one conserved B-Box-type zinc finger domain that is expected to function in a similar manner in each of these related sequences, that is, by playing a central role in transcriptional regulation and in the conferring of shared traits.

Experimental Observations.

G1888 was found to be constitutively expressed in all tissues and environmental conditions tested based on RT-PCR expression analysis. The function of this gene was analyzed using transgenic plants in which G1888 was expressed under the control of the 35S promoter at that time. Overexpression of G1888 produced plants with dark green leaves, markedly slowed development (bolting and senescing late), and reduced overall plant size. When grown on MS agar plates, increased leaf anthocyanin levels and chlorosis were noted.

We have now analyzed the function of G1888 by characterizing 35S:G1888 overexpressing lines in a C/N sensing assay. Anthocyanin accumulation was strikingly elevated compared to that observed in control wild-type seedlings (Table 14). It should be noted that the higher levels of anthocyanin seen in these assays could be related to the generally darker coloration of 35S::G1888 lines that we observed previously. It is interesting that the gene is most closely related to G1482, which also causes elevation of anthocyanin levels in seedlings when overexpressed. Thus, this pair of genes might represent transcriptional regulators of the phenylpropanoid pathway and as such might be used to impact a variety of additional traits such as disease responses, lignin composition, and nutritional quality.

Utilities.

These assays indicate that G1888 and its equivalogs are potential regulators of a plant's response to low nutrient conditions. For further analysis, see the discussion above: "Potential Applications of Polynucleotides and Polypeptides that Regulate C/N sensing".

The G2117 Clade of Transcription Factor Polypeptides

G2117 (SEQ ID NO: 455 and 456)

G2117 (AT1G68880) was identified in the sequence of BAC T6L1 (GenBank accession AC011665) released by the Arabidopsis Genome Initiative and is a member of the bZIP transcription factor family. It has also been described as AtbZIP8 (GenBank accession number AF400621). G2117 and closely-related clade member sequences each comprise a conserved basic region leucin zipper (bZIP) domain that is expected to function in a similar manner in each of these related sequences, that is, by playing a central role in transcriptional regulation and in the conferring of shared traits.

Experimental Observations.

RT-PCR expression analysis indicated that G2117 was highly expressed in roots compared to all other tissues tested. The function of G2117 was analyzed using transgenic plants in which the gene was expressed under the control of the 35S promoter. Plants overexpressing G2117 had altered leaf morphology, coloration, and smaller overall plant size and were generally small with short, rounded, dark green leaves that became curled later in development. These plants generated thin inflorescence stems developed a rather bushy appearance, and had reduced fertility.

We have now analyzed the function of G2117 by characterizing 35S:G2117 overexpressing lines in a C/N sensing assay. Anthocyanin accumulation was elevated compared to the levels observed in control wild-type seedlings (Table 14). Thus, G2117 could have a role in the response to nutrient limitation. However, given that increased anthocyanin levels were seen on control plates, the phenotype is possibly an aspect of darker coloration seen in these lines, rather than an indicator of a C/N sensing response.

Utilities.

These assays indicate that G2117 and its equivalogs are potential regulators of a plant's response to low nutrient conditions. For further analysis, see the discussion above: "Potential Applications of Polynucleotides and Polypeptides that Regulate C/N sensing".

The G2131 Clade of Transcription Factor Polypeptides
G2131 (SEQ ID NO: 457 and 458)

G2131 (AT1G79700) corresponds to gene F20B17.12 (GenBank accession AAF68121) and is a member of the AP2 transcription factor family. G2131 and closely-related clade member sequences each comprise a conserved AP2 DNA binding domain that is expected to function in a similar manner in each of these related sequences, that is, by playing a central role in transcriptional regulation and in the conferring of shared traits. G2131 and closely-related clade member sequences each comprise a conserved domain that is expected to function in a similar manner in each of these related sequences, that is, by playing a central role in transcriptional regulation and in the conferring of shared traits.

Experimental Observations.

RT-PCR expression analysis indicated that G2131 is ubiquitously expressed and was not significantly induced by any of the environmental conditions tested. At that time, the function of G2131 was studied using transgenic plants in which the gene was expressed under the control of the 35S promoter. 35S::G2131 plants did not show consistent alterations in morphology and development, and were essentially wild type in the physiological analyses that were performed.

G2131 overexpressing plants showed elevated levels of campesterol in leaves.

We have now analyzed 35S::G2131 seedlings in a C/N sensing assay. Anthocyanin accumulation was significantly less than that observed in control wild-type seedlings (Table 14). Thus, this gene is indicated as having a role in responses to nutrient limitation.

Utilities.

Phytosterols are an important source of precursors for the manufacture of human steroid hormones by semisynthesis. Sitosterols and stigmasterols, not campesterol, are the preferred sources from seed crops. However, it is conceivable that proper regulation of G2131 expression or activity could lead to elevated levels of the important human steroid precursors. Phytosterols and their hydrogenated derivatives phytostanols also have proven cholesterol-lowering properties. However, it is unclear what the relative efficacies of sitosterol and campesterol are for lowering blood cholesterol levels. If G2131 could be used to increase total phytosterol levels in leaves, it would be very useful for both types of applications.

These assays indicate that G2131 and its equivalogs are potential regulators of a plant's response to low nutrient conditions. For further analysis, see the discussion above: "Potential Applications of Polynucleotides and Polypeptides that Regulate C/N sensing".

The G2520 Clade of Transcription Factor Polypeptides
G2520 (SEQ ID NO: 459 and 460)

The sequence of G2520 (AT1G59640) was originally obtained from *Arabidopsis* genomic sequencing project, GenBank accession number AC009317, based on its sequence similarity within the conserved domain to other bHLH related proteins. G2520 and closely-related clade member sequences each comprise a conserved HLH DNA-binding and dimerization domain that is expected to function in a similar manner in each of these related sequences, that is, by playing a central role in transcriptional regulation and in the conferring of shared traits.

Experimental Observations.

RT-PCR expression analysis indicated that G2520 was expressed ubiquitously. At that time, the function of G2520 was analyzed using transgenic plants in which G2520 was expressed under the control of the 35S promoter. At early stages, 35S::G2520 transformants displayed abnormal curled cotyledons, long hypocotyls, and rather short roots. During the vegetative phase, these plants were formed somewhat small flat leaves. Following the switch to reproductive growth, 35S::G2520 inflorescences were typically very spindly, slightly pale colored, and stems often split open at late stages. Flowers were frequently small with narrow organs and showed poor pollen production. Because of these defects, seed yield from 35S::G2520 plants was low compared to wild-type controls.

We have now analyzed 35S::G2520 seedlings in a C/N sensing assay. Anthocyanin accumulation was significantly less than that observed in control wild-type seedlings (Table 14), indicating that this gene might have a role in the response to nutrient limitation.

Interestingly, we previously observed that overexpression lines showed light response phenotypes such as long hypocotyls, and a pale coloration (reduced levels of pigmentation). However, it remains to be determined whether the response to low nutrient conditions is related to these effects. However, it is interesting compare the strikingly similar effects on pigment production observed between 35S::G2520 lines and overexpression lines from the G682 sub-clade reports. Given that genes from the MYB family are in some cases known to have partners in the HLH/MYC family, it is possible that the G2520 might act in the same pathway.

Utilities.

In addition to the observed shade avoidance phenotype, these assays indicate that G2520 and its equivalogs are potential regulators of a plant's response to low nutrient conditions. For further analysis, see the discussion above: "Potential Applications of Polynucleotides and Polypeptides that Regulate C/N sensing".

The G2522 Clade of Transcription Factor Polypeptides

G2522 (SEQ ID NO: 461 and 462)

The sequence of G2522 (AT3G61310) was initially obtained from the *Arabidopsis* genomic sequencing project (GenBank accession AL137898) based on its sequence similarity within the conserved domain to other AT-hook related proteins. G2522 and closely-related clade member sequences each comprise a conserved domain that is expected to function in a similar manner in each of these related sequences, that is, by playing a central role in transcriptional regulation and in the conferring of shared traits. G2522 and closely-related clade member sequences each comprise a conserved At-hook domain and a second conserved domain (amino acids 143-291) or the DUF296 domain (amino acids 164-284) that are expected to function in a similar manner in each of these related sequences, that is, by playing a central role in transcriptional regulation and in the conferring of shared traits Experimental Observations.

RT-PCR expression analysis indicated that G2522 is expressed at moderate levels in flowers, embryos, and siliques, and is found at significantly lower levels throughout the rest of the plant. The gene was not significantly induced by any environmental condition tested. The function of G2522 was also analyzed using transgenic plants in which G2522 was expressed under the control of the 35S promoter. Overexpression of G2522 did not produce any consistent phenotypic alteration in any assay performed when compared to wild-type control plants.

We have now analyzed 35S::G2522 seedlings in a C/N sensing assay. Anthocyanin accumulation was slightly less than that observed in control wild-type seedlings (Table 14), indicating that the gene might have a role in the response to low nutrient conditions.

Utilities.

These assays indicate that G2522 and its equivalogs are potential regulators of a plant's response to low nutrient conditions. For further analysis, see the discussion above: "Potential Applications of Polynucleotides and Polypeptides that Regulate C/N sensing".

Table 14 lists the results obtained with transgenic seedlings germinated on two different media for the purpose of differentiating plants with altered C/N sensing. The first column lists the Gene Identification Number (GID), the second column identifies the gene family of the corresponding sequence, the third column identifies whether the gene was overexpressed or knocked out, and the fourth and fifth columns list the results obtained with high sucrose media lacking a nitrogen source and high sucrose media with glutamine as a nitrogen source, respectively. Generally, increased tolerance was measured as lower anthocyanin accumulation than controls, and increased sensitivity as greater anthocyanin accumulation than controls. The plants' responses as they appear in the fourth and fifth columns were given one of four scores:

++ markedly enhanced tolerance;

+ mild/moderately enhanced tolerance;

wt comparable tolerance to wild-type controls, and

− mild to moderately increased sensitivity.

TABLE 14

Sequences identified as modifying the response to nutrient limitation in C/N sensing assays

| GID | Gene family | OE/KO | Response of transgenic plants on high sucrose without a nitrogen source | Response of transgenic plants on high sucrose plus glutamine |
|---|---|---|---|---|
| G24 | AP2 | OE | + | + |
| G154 | MADS | OE | + | + |
| CPC | MYB-related | OE | ++ | ++ |
| G226 | MYB-related | OE | ++ | ++ |
| G384 | HB | OE | − | − |
| G486 | CAAT | OE | + | + |
| G545 | Z-C2H2 | OE | − | − |
| G682 | MYB-related | OE | ++ | + |
| G760 | NAC | OE | − | − |
| G773 | NAC | OE | − | − |
| G937 | GARP | OE | + | + |
| G971 | AP2 | OE | − | − |
| G988 | SCR | OE | − | − |
| G989 | SCR | OE | + | + |
| G1069 | AT-hook | OE | + | + |
| G1090 | AP2 | OE | + | + |
| G1322 | MYB-(R1)R2R3 | OE | ++ | ++ |
| G1587 | HB | OE | + | + |
| G1666 | HLH/MYC | KO | + | + |
| G1700 | RING/C3H2C3 | KO | + | + |
| G1816 | MYB-related | OE | ++ | + |
| G1818 | CAAT | OE | + | + |
| G1868 | GRF-like | OE | + | + |
| G1888 | Z-CO-like | OE | − | − |
| G2117 | bZIP | OE | − | − |
| G2131 | AP2 | OE | ++ | ++ |
| G2520 | HLH/MYC | OE | ++ | ++ |
| G2522 | AT-hook | OE | + | + |
| G2718 | MYB-related | OE | ++ | + |
| G2789 | AT-hook | OE | ++ | ++ |
| G8 | AP2 | OE | − | − |
| G27 | AP2 | OE | wt | − |
| G156 | MADS | OE | + | + |
| G161 | MADS | OE | − | − |
| G168 | MADS | OE | − | wt |
| G183 | WRKY | OE | + | + |
| G189 | WRKY | OE | + | + |
| G200 | MYB-(R1)R2R3 | KO | − | − |
| G234 | MYB-(R1)R2R3 | OE | + | + |
| G237 | MYB-(R1)R2R3 | OE | + | + |
| G275 | AKR | OE | + | + |
| G326 | Z-CO-like | OE | − | − |
| G347 | Z-LSD-like | OE | wt | + |
| G427 | HB | OE | + | + |
| G505 | NAC | OE | − | − |
| G590 | HLH/MYC | OE | + | + |
| G602 | DBP | OE | + | + |
| G618 | TEO | OE | + | + |
| G635 | TH | OE | + | + |
| G643 | TH | OE | + | + |
| G653 | Z-LIM | OE | + | + |
| G657 | MYB-(R1)R2R3 | OE | wt | + |
| G837 | AKR | OE | wt | + |
| G866 | WRKY | OE | + | + |
| G872 | AP2 | OE | + | + |
| G904 | RING/C3H2C3 | OE | + | + |
| G912 | AP2 | OE | + | + |
| G932 | MYB-(R1)R2R3 | OE | wt | + |
| G958 | NAC | OE | + | wt |
| G964 | HB | KO | ++ | + |
| G975 | AP2 | OE | + | + |
| G979 | AP2 | OE | wt | + |
| G1049 | bZIP | OE | + | + |
| G1246 | MYB-(R1)R2R3 | OE | + | + |
| G1255 | Z-CO-like | OE | + | + |
| G1266 | AP2 | OE | wt | + |
| G1331 | MYB-(R1)R2R3 | OE | + | + |
| G1332 | MYB-(R1)R2R3 | OE | + | + |
| G1494 | HLH/MYC | OE | + | + |
| G1535 | HB | KO | wt | + |

TABLE 14-continued

Sequences identified as modifying the response to nutrient limitation in C/N sensing assays

| GID | Gene family | OE/ KO | Response of transgenic plants on high sucrose without a nitrogen source | Response of transgenic plants on high sucrose plus glutamine |
|---|---|---|---|---|
| G1649 | HLH/MYC | OE | + | + |
| G1750 | AP2 | OE | + | + |
| G1773 | RING/C3HC4 | KO | + | + |
| G1835 | GATA/Zn | OE | wt | − |
| G1930 | AP2 | OE | + | + |
| G2053 | NAC | OE | wt | + |
| G2057 | TEO | OE | + | + |
| G2133 | AP2 | OE | wt | + |
| G2144 | HLH/MYC | OE | + | + |
| G2145 | HLH/MYC | OE | + | + |
| G2295 | MADS | OE | + | + |
| G2512 | AP2 | OE | + | + |
| G2531 | NAC | OE | + | wt |
| G2535 | NAC | OE | − | − |
| G2590 | MADS | OE | + | + |
| G2719 | MYB-(R1)R2R3 | OE | + | + |
| G1792 | AP2 | OE | + | + |

Abbreviations and symbols: wt wild-type response
+ increased growth and/or vigor relative to wild-type
− decreased growth and/or vigor relative to wild-type Example X: Results of Shade Tolerance Assays This example provides experimental evidence for increased shade tolerance controlled by transcription factor polypeptides and polypeptides of the invention.

The twelve shade avoidance-inducing sequences that were most extensively scrutinized spanned a range of diverse gene families: TH (G634), bZIP (G1048), RING/C3H2C3 (G1100), NAC (G1412, G2505), AP2 (G1796), Z-C2H2 (G1995), HS (G2467), HB (G2550), SRS (G2640), WRKY (G2686), and AT-hook (G2789). Experimental data are provided for each of these sequences in Example VIII, but a number of the genes warrant special mention here.

G634 is of particular interest since we have determined that 35S::G634 Arabidopsis lines also show enhanced drought tolerance in addition to shade tolerance. This gene could therefore confer yield savings via multiple different traits.

The same ability to confer enhanced performance and yield by improving multiple traits is true for G2789. Overexpressors of G2789 were shown to be insensitive to ABA, had altered carbon:nitrogen balance sensing (and thus overexpressors of this gene may thrive better than wild type under low nutrient conditions), were osmotic stress tolerant, and recovered better from drought than wild-type plants in a soil-based drought assay.

A G1412 homozygous T-DNA insertion mutant line for this gene showed shade tolerance. Thus, G1412 might be a target for obtaining shade tolerance via a non-transgenic strategy by screening for mutant lines of crops that carry a lesion within the ortholog(s) of G1412.

A number of the top lead genes, particularly G2550 and G2640, produced Arabidopsis plants with a compact shoot morphology when overexpressed, which may represent a constitutive shade avoidance phenotype. Such features are similar to those seen in the high-yielding dwarf varieties of cereals that facilitated the so-called "green revolution." The effects of G2550 and G2640 overexpression on yield will be examined in target crop species.

The G634 Clade of Transcription Factor Polypeptides
G634 (SEQ ID NO: 231 and 232)

G634 (AT1G33240) was initially identified as two public partial cDNAs sequences (GTL1 and GTL2) which are splice variants of the same gene (Smalle et al. (1998) Proc. Natl. Acad. Sci. USA 95: 3318-3322). The published expression pattern shows that G634 is highly expressed in siliques and not expressed in leaves, stems, flowers or roots. G634 and closely-related clade member sequences each comprise at least one conserved TH domain that is expected to function in a similar manner in each of these related sequences, that is, by playing a central role in transcriptional regulation and in the conferring of shared traits.

Experimental Observations.

Three constructs were initially made for G634: P324 (SEQ ID NO: 1015), P1374 (SEQ ID NO: 1013) and P1717 (SEQ ID NO: 1017). P324 was found to encode a shortened version of the G634 protein (SEQ ID NO: 1016). P1374 and P1717 represent longer splice variants of G634 (SEQ ID NOs: 1014 and 1018, respectively). Overexpression lines for P1717 were never analyzed. However lines for P324 showed some variable effects on size, but otherwise appeared normal. Plants overexpressing G634 had a dramatic increase in the density of trichomes. The trichomes were also larger in size than those of wild-type plants. The increase in trichome density was most noticeable on later arising rosette leaves, cauline leaves, inflorescence stems and sepals with the stem trichomes being more highly branched than controls. Approximately half of the primary transformants and two of three T2 lines showed the phenotype.

G634 overexpressing Arabidopsis lines did not exhibit a shade avoidance phenotype when grown under light deficient in the red region of the visible spectrum; in experiments comparing 35S::G634 plants with wild type controls, individual seedlings were examined after being grown under light deficient in red wavelengths (b/FR). The G634 overexpressors did not exhibit a shade avoidance phenotype, as indicated by their short hypocotyls produced under these conditions.

We recently tested lines for P324 and P1374 in a soil drought assay and found that they showed an enhanced performance versus wild type; G634 overexpressors recovered from the effects of a drought treatment significantly better than wild-type control plants. Additionally, our recent array experiments on plants undergoing a soil-drought experiment, indicated that G634 shows a small but significant up-regulation specifically in the recovery phase, following re-watering at the end of the drought (see patent application Ser. No. 10/714,887).

Utilities.

We have now analyzed 35S::G634 lines (containing P1374, SEQ ID NO: 1013, which encodes SEQ ID NO: 1014) under white light versus light deficient in red wavelengths. All three lines tested did not exhibit a shade avoidance phenotype under conditions where wild-type seedlings had enhanced hypocotyl elongation.

The G1048 Clade of Transcription Factor Polypeptides
G1048 (SEQ ID NO: 807 and 808)

G1048 (AT1G42990) was initially identified as public partial EST T88194 and in BAC F13A11 (GenBank accession AC068324) released by the Arabidopsis Genome Initiative. G1048 and closely-related clade member sequences each comprise a conserved basic region leucin zipper (bZIP) domain that is expected to function in a similar manner in each of these related sequences, that is, by playing a central role in transcriptional regulation and in the conferring of shared traits.

Experimental Observations.

During the genomics program, RT-PCR expression analysis indicated that G1048 was constitutively expressed and not induced by any condition tested. At that time, the function of G1048 was investigated by constitutively expressing G1048 using the 35S promoter. Plants overexpressing G1048 were not significantly different to controls in any assay performed.

G1048 overexpressing lines did not exhibit a shade avoidance phenotype when grown under light deficient in the red region of the visible spectrum; individual seedlings grown on light deficient in red wavelengths (b/FR) were compared with wild-type control seedlings. This effect was seen in two repeat experiments on a batch of mixed seed from three independent lines.

Utilities.

We have now analyzed 35S::G1048 lines grown under white light versus light deficient in red light. A shade tolerance phenotype was observed, indicating that G1048 might be involved in the transcriptional regulation of response to shade or light quality. As yet, though, the phenotype observed in a mixed batch of 35S::G1048 lines has not been confirmed by testing of individual lines. However, this gene was given an "A" ranking because the phenotype seen in the screen on mixed lines was moderately strong, and because G1048 is potentially related to HY5 (Oyama et al. (1997) *Genes Dev.* 11:2983-2995), a gene that is well established to be involved in light regulated development.

The G1100 Clade of Transcription Factor Polypeptides G1100 (SEQ ID NO: 809 and 810)

G1100 was identified in the sequence of BACs T29F13, F1913 and T4C15 based on its sequence similarity within the conserved domain to other RING C3H2C3 related proteins in *Arabidopsis*. G1100 and closely-related clade member sequences each comprise a conserved RING finger domain that is expected to function in a similar manner in each of these related sequences, that is, by playing a central role in transcriptional regulation and in the conferring of shared traits.

Experimental Observations.

In our earlier genomics program, the function of G1100 was analyzed by disrupting the gene with a T-DNA insertion. Homozygotes for this insertion appeared wild type in all assays performed. For the present experiments, the function of G1100 was studied using transgenic plants in which the gene was expressed under the control of the 35S promoter. Overexpression of G1100 resulted in plants that were small, dark green, and slow developing. These effects were most prominent at later stages. Flowers were also small, had defects in organ formation and pollen production, and set few seeds. RT-PCR analysis indicated that G1100 is strongly and specifically induced by drought and salicylic acid, and is not detectable under normal conditions.

G1100 overexpressing lines did not exhibit a shade avoidance phenotype when grown under light deficient in red region of the visible spectrum; individual seedlings grown on light deficient in red wavelengths (b/FR) were compared with wild-type control seedlings. When the assay was repeated on individual lines, all three lines analyzed showed the phenotype. 35S::G1100 seedlings had short hypocotyls compared with wild-type seedlings.

Utilities.

We have now analyzed 35S::G1100 lines grown under white light or deficient in red light. All three lines did not exhibit a shade avoidance phenotype under conditions where wild-type seedlings had enhanced hypocotyl elongation.

The G1412 Clade of Transcription Factor Polypeptides G1412 (SEQ ID NO: 657 and 658)

G1412 is a member of the NAC family of transcription factors. G1412 corresponds to gene At4g27410 and to sequence 1543 from Harper (2002) Patent Application WO 0216655-A. In this application, G1412 was reported to be cold, osmotic and salt responsive in their microarray analysis (WO 0216655-A). G1412 and closely-related clade member sequences each comprise a conserved NAC domain that is expected to function in a similar manner in each of these related sequences, that is, by playing a central role in transcriptional regulation and in the conferring of shared traits.

Experimental Results.

In our original genomics screens, G1412 appeared to be constitutively expressed in all tissues tested using RT-PCR analysis. Induction of G1412 in leaf tissue was observed in response to ABA, heat, drought, and mannitol. This result was confirmed by microarray experiments, which showed that G1412 is induced by a variety of drought related treatments.

In our earlier studies, a T-DNA insertion mutant for G1412 was not shown to be morphologically different from wild type. 35S::G1412 transgenic plants showed normal morphology but were insensitive to ABA, and were significantly more tolerant to osmotic stress in a germination assay on media containing high concentrations of sucrose.

In our most recent experiments, T-DNA insertion mutants for G1412 did not exhibit a shade avoidance phenotype when grown under light deficient in red region of the visible spectrum. Individual seedlings grown on light deficient in red wavelengths (b/FR) were compared with wild-type control seedlings; The G1412 knock-out seedlings had short hypocotyls compared with wild-type seedlings.

Utilities.

We have now analyzed KO.G1412 seedlings grown under white light versus light deficient in the red wavelengths. KO.G1412 seedlings did not exhibit a shade avoidance phenotype under conditions where wild-type seedlings had enhanced hypocotyl elongation. Thus, G1412 might be required to mediate the shade avoidance response. However, 35S::G1412 lines were not observed to show alterations in light-regulated development, suggesting that this gene is not sufficient to trigger a shade response.

The G1796 Clade of Transcription Factor Polypeptides G1796 (SEQ ID NO: 811 and 812)

G1796 (At1g12980) is found in the sequence of GenBank accession number AC007357. G1796 was identified by Banno et al. (Banno et al. (2001) *Plant Cell* 13: 2609-2618) as ESR1 (ENHANCER OF SHOOT REGENERATION) in a screen for *Arabidopsis* cDNAs that could confer cytokinin-independent shoot formation from root cultures when overexpressed. G1796 was found to be included in Patent Application WO0200903. G1796 and closely-related clade member sequences each comprise a conserved AP2 DNA-binding domain that is expected to function in a similar manner in each of these related sequences, that is, by playing a central role in transcriptional regulation and in the conferring of shared traits.

Experimental Results.

In our earlier genomics program, overexpression of G1796 was shown to cause growth defects: seedlings were generally small and formed dark curled leaves. Portions of the flower and overall structure of the inflorescence were also affected. Flowers had poorly developed outer whorl organs and formed thickened club-like carpels. RT-PCR expression analysis indicated that G1796 was expressed at low levels in root, flower and rosette, but not in stems, siliques, embryos or germinating seeds.

Seedlings of overexpressing lines and wild-type controls were grown on light deficient in red wavelengths (b/FR) and compared. Under these conditions, the G1796 overexpressing lines did not exhibit a shade avoidance phenotype.

Utilities.

We have now analyzed 35S::G1796 seedlings grown under white light or white light deficient in wavelengths corresponding to the red region of the visible spectrum. 35S::G1796 seedlings did not exhibit a shade avoidance phenotype under conditions where wild-type seedlings had enhanced hypocotyl elongation. This gene was given an "A" ranking because the phenotype seen in the screen on mixed lines was moderately strong.

35S::G1796 seedlings were also dark green in color compared to wild type, confirming a result seen earlier in the earlier genomics program.

The G1995 Clade of Transcription Factor Polypeptides
G1995 (SEQ ID NO: 813 and 814)

G1995 (At3g58070) was identified in the sequence of BAC T10K17 (GenBank accession number AL132977) based on its sequence similarity within the conserved domain to other Z-C2H2 related proteins in *Arabidopsis*. G1995 and closely-related clade member sequences each comprise a conserved C2H2 DNA-binding zinc finger domain that is expected to function in a similar manner in each of these related sequences, that is, by playing a central role in transcriptional regulation and in the conferring of shared traits.

Experimental Results.

The function of G1995 was studied using transgenic plants in which the gene was expressed under the control of the 35S promoter. Overexpression of G1995 resulted in plants that were rather small, slow growing, and that had flowers with increased trichome density on sepals and ectopic trichomes on carpels. The flowers also had rather poor pollen production and many of the lines yielded only relatively small quantities of seed. Additionally a single extreme line displayed aerial rosette like structures and had floral organs that were converted towards a bract-like identity. Interestingly, in the strongest lines, the plants failed to undergo a clear transition to reproductive growth and formed leafy floral organs with vegetative characteristics. Thus, G1995 might regulate this developmental transition.

In physiological analyses G1995 overexpressors showed size segregation and a slight increase in sensitivity to nutrient limitation.

Seedlings of overexpressing lines and wild-type controls were grown on light deficient in red wavelengths (b/FR) and compared. Under these conditions, the G1995 overexpressing lines did not exhibit a shade avoidance phenotype.

Utilities.

We have now analyzed 35S::G1995 seedlings grown under white light or white light deficient in wavelengths corresponding to the red region of the visible spectrum. 35S::G1995 seedlings did not exhibit a shade avoidance phenotype under conditions where wild-type seedlings had enhanced hypocotyl elongation. Two out of three lines did not exhibit a shade avoidance phenotype.

It should be noted that G1995 is closely related to five other Z-C2H2 genes we have previously analyzed: G370, G2826, G361, G362, and G2838, which produced broadly similar phenotypes when overexpressed, such as ectopic trichomes on flowers, aerial rosettes, and various other morphological defects. Importantly, these genes all produced a general failure in the vegetative to reproductive transition and showed floral organs that were leaf-like. This effect, and the absence of hypocotyl elongation seen in 35S::G1995 lines in this assay, could indicate that this group of TFs is involved in mediating a range of phytochrome regulated responses. However, we did not observe any effect on hypocotyl elongation when these other Z-C2H2 overexpressing plants were examined in our shade avoidance screen. Nevertheless, it should be noted that the lines were generally of very poor fertility and strongly affected lines set insufficient seed for inclusion in the shade tolerance assay (i.e. only lines with a relatively weak morphological phenotype could be tested).

The G2467 Clade of Transcription Factor Polypeptides
G2467 (SEQ ID NO: 815 and 816)

G2467 is a member of the class-A heat shock transcription factor family characterized by an extended HR-A/B oligomerization domain. G2467 is found in the sequence of the P1 clone MAA21 (GenBank accession AL163818) released by the *Arabidopsis* Genome Initiative. G2467 and closely-related clade member sequences each comprise a conserved HSF-type DNA-binding domain (or HS domain) that is expected to function in a similar manner in each of these related sequences, that is, by playing a central role in transcriptional regulation and in the conferring of shared traits.

Experimental Observations.

In studies performed during the earlier genomics program, 35S::G2467 transformants were generally smaller than wild type, and formed rather thin inflorescence stems that carried flowers that sometimes displayed abnormal, poorly developed organs. Additionally, rosette leaf senescence appeared to occur prematurely.

Seedlings of overexpressing lines and wild-type controls were grown on light deficient in red wavelengths (b/FR) and compared. Under these conditions, the G2467 overexpressing lines did not exhibit a shade avoidance phenotype. When individual lines were retested, one line did not exhibit a shade avoidance phenotype whereas two lines were wild type in their response.

Utilities.

We have now analyzed 35S::G2467 seedlings grown under white light or white light deficient in wavelengths corresponding to the red region of the visible spectrum. 35S::G2467 seedlings did not exhibit a shade avoidance phenotype under conditions where wild-type seedlings had enhanced hypocotyl elongation.

The G2505 Clade of Transcription Factor Polypeptides
G2505 (SEQ ID NO: 817 and 818)

G2505 (AT4G10350) is a novel member of the NAC family of transcription factors. G2505 and closely-related clade member sequences each comprise a conserved NAC domain that is expected to function in a similar manner in each of these related sequences, that is, by playing a central role in transcriptional regulation and in the conferring of shared traits.

Experimental Observations.

During our earlier genomics program, RT-PCR expression analysis indicated that G2505 was expressed at low or non-detectable levels in most tissue types. However, higher levels of transcript were found in roots compared to other tissues. No induction of G2505 expression in leaf tissue was detected in response to environmental stress related conditions. At that time, it was extremely hard to obtain 35S::G2505 transformants. A few lines were obtained and these were distinctly small and dark in coloration. Only two of these lines produced sufficient seed for physiology assays to be performed. However, both of those lines displayed enhanced performance in a severe drought assay.

G2505 overexpressing lines (from a mixed seed lot comprised of two independent transgenic lines) and wild-type controls were grown on light deficient in red wavelengths (b/FR) and compared. Under these conditions, the G2505 overexpressing lines did not exhibit a shade avoidance phenotype.

Utilities.

We have now analyzed 35S::G2505 lines grown under white light versus light deficient in red light. 35S::G2505 seedlings exhibited a shade tolerant phenotype, suggesting that this gene might be involved in light regulated development. However, it should be noted that as yet, the phenotype observed in a mixed batch of 35S::G2505 lines has not been confirmed by testing of individual lines. Nevertheless, this gene was given an "A" ranking because the phenotype seen in the screen on mixed lines was moderately strong.

The G2550 Clade of Transcription Factor Polypeptides G2550 (SEQ ID NO: 819 and 820)

We initially identified G2550 within sequence released by the *Arabidopsis* Genome Initiative (GenBank accession AC023754) as a gene encoding a novel homeodomain protein of the BEL1 class. G2550 and closely-related clade member sequences each comprise a conserved POX domain and a homeodomain domain that is expected to function in a similar manner in each of these related sequences, that is, by playing a central role in transcriptional regulation and in the conferring of shared traits.

Experimental Observations.

During our genomics program, 35S::G2550 transgenic plants exhibited a wild-type response to physiological assays, but displayed a number of morphological phenotypes. Initially, 35S::G2550 seedlings appeared wild type at early stages. However, at the mid rosette stage, 35S::G2550 lines were dark in coloration, displayed alterations in leaf shape, and formed shorter more compact inflorescences than controls. Following the switch to flowering, 35S::G2550 transformants formed short, compact, bushy inflorescences, which had reduced internode elongation, and flowers bunched together at the tips. Fertility also appeared reduced, silique set was rather poor, and senescence was somewhat delayed compared to wild type.

Seedlings of overexpressing lines and wild-type controls were grown on light deficient in red wavelengths (b/FR) and compared. Under these conditions, the G2550 overexpressing lines did not exhibit a shade avoidance phenotype.

Utilities.

We have now analyzed 35S::G2550 seedlings grown under white light or white light deficient in wavelengths corresponding to the red region of the visible spectrum. 35S::G2550 seedlings did not exhibit a shade avoidance phenotype under conditions where wild-type seedlings had enhanced hypocotyl elongation. However, it be should noted that the 35S::G2550 lines had short internodes and were short and compact at adult stages. Thus, the shade tolerance phenotype (reduced hypocotyl elongation) observed in the current study could be part of the general dwarf phenotype seen in these lines.

The G2640 Clade of Transcription Factor Polypeptides G2640 (SEQ ID NO: 821 and 822)

G2640, a member of the SRS (SHORT INTERNODES, SHI) transcription factor family, corresponds to AT3G51060 as annotated by the *Arabidopsis* Genome Initiative. The founding member of the SRS family has been implicated in the suppression of GA induced cell elongation. G2640 and closely-related clade member sequences each comprise a conserved DUF702 domain comprising at least one zinc finger domain that is expected to function in a similar manner in each of these related sequences, that is, by playing a central role in transcriptional regulation and in the conferring of shared traits.

Experimental Observations.

The function of G2640 was analyzed in our genomics program using transgenic plants in which a cDNA clone of the gene was expressed under the control of the 35S promoter. While 35S::G2640 lines displayed a wild-type response in all of the physiological assays, several developmental alterations were observed during morphological analysis. 35S::G2640 transformants were smaller than wild type controls and produced leaves with short petioles. Inflorescences from these plants were compact and had very short internodes. Flowers displayed a variety of non-specific abnormalities with organs often being poorly developed. As a result of such defects, the seed yield from most of the lines was very low.

Seedlings of overexpressing lines and wild-type controls were grown on light deficient in red wavelengths (b/FR) and compared. Under these conditions, the G2640 overexpressing lines did not exhibit a shade avoidance phenotype. When individual lines were tested, two lines did not exhibit a shade avoidance phenotype, and were observed to have long narrow leaves.

Utilities.

We have now analyzed 35S::G2640 seedlings grown under white light or white light deficient in wavelengths corresponding to the red region of the visible spectrum. 35S::G2640 seedlings did not exhibit a shade avoidance phenotype under conditions where wild-type seedlings had enhanced hypocotyl elongation. This phenotype was only seen in two lines (an individual line repeat could not be performed using the third line because seed was not available).

It should be should noted that during our initial genomics program, we observed that 35S::G2640 lines were rather short and compact at adult stages. Thus, the shade tolerance phenotype (reduced hypocotyl elongation) observed in the current study could be part of the general short internode phenotype seen in these lines.

The G2686 Clade of Transcription Factor Polypeptides G2686 (SEQ ID NO: 823 and 824)

G2686 corresponds to gene At1g66600, and it has also been described as WRKY63. G2686 and closely-related clade member sequences each comprise a conserved WRKY DNA-binding domain that is expected to function in a similar manner in each of these related sequences, that is, by playing a central role in transcriptional regulation and in the conferring of shared traits.

Experimental Observations.

We had previously studied the function of the gene was using transgenic plants in which the gene was expressed under the control of the 35S promoter. G2686 overexpressing lines behaved similarly to the wild-type controls in all physiological assays performed. However, in morphological examinations, 35S::G2686 plants were observed to be generally smaller than wild-type controls. Some lines also had short rounded leaves.

Seedlings of overexpressing lines and wild-type controls were grown on light deficient in red wavelengths (b/FR) and compared. Under these conditions, the G2686 overexpressing lines did not exhibit a shade avoidance phenotype. When individual lines were retested, two of three lines did not exhibit a shade avoidance phenotype.

Utilities.

We have now analyzed 35S::G2686 seedlings grown under white light or white light deficient in wavelengths corresponding to the red region of the visible spectrum. 35S::G2686 seedlings did not exhibit a shade avoidance phenotype under conditions where wild-type seedlings had enhanced hypocotyl elongation. However, the shade tolerance phenotype (reduced hypocotyl elongation) observed in the current study could be part of the general small size phenotype that was earlier seen in these lines.

The G1073 Clade of Transcription Factor Polypeptides
G2789 (SEQ ID NO: 247 and 248)

The sequence of G2789 (AT3G60870) was obtained from the *Arabidopsis* genome sequencing project (GenBank accession AL162295) based on its sequence similarity to other AT-hook related proteins. G2789 and closely-related clade member sequences each comprise a conserved At-hook domain and a second conserved domain (amino acids 68-208) or the DUF296 domain (amino acids 86-201) that are expected to function in a similar manner in each of these related sequences, that is, by playing a central role in transcriptional regulation and in the conferring of shared traits.

Experimental Observations.

During earlier studies, RT-PCR analysis indicated that G2789 was expressed at moderate levels in roots, flowers, embryos, siliques, and germinating seeds. It was not detectable in rosette leaves or shoots. No significant induction of G2789 was observed in rosette leaves by any condition tested. At this time, the function of this gene was analyzed using transgenic plants in which G2789 was expressed under the control of the 35S promoter. Overexpression of G2789 in *Arabidopsis* resulted in seedlings that were ABA insensitive, had significantly more osmotic stress tolerance than wild-type plants, had altered carbon:nitrogen balance sensing, were osmotic stress tolerant, and recovered better from drought that wild-type plants in soil-based drought assays.

Overexpression of G2789 also produced alterations in leaf and flower development, and caused severe reductions in fertility.

Seedlings of overexpressing lines and wild-type controls were grown on light deficient in red wavelengths (b/FR) and compared. Under these conditions, the G2789 overexpressing lines did not exhibit a shade avoidance phenotype. When the assay was repeated on individual lines, two of three lines analyzed showed a shade tolerant phenotype and had short hypocotyls compared with wild-type seedlings. One line was wild type.

Utilities.

We have now analyzed 35S::G2789 lines grown under white light versus light deficient in red light. Two of three lines tested exhibited a shade tolerance phenotype under conditions where wild-type seedlings had enhanced hypocotyl elongation. Thus, G2789 might be involved in the modulation of light regulated development. It remains to be determined whether this function is related to the apparent involvement of the gene in conferring abiotic stress tolerance and tolerance to low nutrient availability.

Summary of Results for Above GIDs and Others Tested

TABLE 15

GIDs identified as conferring shade tolerance under low R:FR conditions

| GID | Gene family | OE/KO | Lines tested | PID of OEX construct | Shade tolerance phenotype[1] | Growth under white light[2] | Priority Ranking[3] |
|---|---|---|---|---|---|---|---|
| G634 | TH | OE | 5, 6, 8 | P1374 | + | − | A |
| G1048 | bZIP | OE | 23, 24, 28 | P1257 | + | − | A |
| G1100 | RING/C3H2C3 | OE | 27, 31, 38 | P1353 | ++ | wt | A |
| G1412 | NAC | KO | KO | NA | + | wt | A |
| G1796 | AP2 | OE | 5, 28, 32 | P2053 | + | − | A |
| G1995 | Z-C2H2 | OE | 22, 37, 38 | P2360 | ++ | wt | A |
| G2467 | HS | OE | 7, 9, 10 | P2744 | + | wt | A |
| G2505 | NAC | OE | 86, 81 | P2776 | + | wt | A |
| G2550 | HB | OE | 1, 3, 4 | P16180 | ++ | wt | A |
| G2640 | SRS | OE | 26, 30, 31 | P2675 | ++ | + | A |
| G2686 | WRKY | OE | 5, 6, 10 | P2095 | + | wt | A |
| G2789 | AT-hook | OE | 5, 9, 19 | P2058 | + | − | A |
| G24 | AP2 | OE | 2, 8, 11 | P969 | + | wt | B |
| G38 | AP2 | OE | 3, 6, 10 | P179 | + | wt | B |
| G44 | AP2 | OE | 4, 5, 6 | P182 | + | wt | B |
| G230 | MYB-(R1)R2R3 | OE | 61, 63, 67 | P810 | + | − | B |
| G234 | MYB-(R1)R2R3 | OE | 1, 2, 3 | P201 | + | wt | B |
| G261 | HS | OE | 1, 2, 3 | P206 | + | + | B |
| G271 | AKR | OE | 3, 4, 5 | P209 | + | − | B |
| G303 | HLH/MYC | OE | 3, 8, 18 | P1410 | + | wt | B |
| G359 | Z-C2H2 | OE | 4, 5, 7 | P2379 | + | wt | B |
| G377 | RING/C3H2C3 | OE | 7, 9, 20 | P1354 | + | wt | B |
| G388 | HB | KO | KO | NA | + | − | B |
| G435 | HB | OE | 4, 8, 16 | P30 | + | − | B |
| G442 | AP2 | OE | 6, 7, 8 | P909 | + | wt | B |
| G468 | IAA | OE | 1, 22, 24 | P2466 | + | wt | B |
| G571 | bZIP | OE | 22, 26, 27 | P1557 | + | wt | B |
| G652 | Z-CLDSH | KO | KO | NA | + | − | B |
| G664 | MYB-(R1)R2R3 | OE | 2, 3, 7 | P98 | + | − | B |
| G772 | NAC | OE | 4, 15, 19 | P868 | + | wt | B |
| G798 | Z-Dof | OE | 1 | P132 | + | wt | B |
| G818 | HS | OE | 12, 16, 19 | P1786 | + | wt | B |
| G971 | AP2 | OE | 1, 14, 18 | P1247 | + | wt | B |
| G974 | AP2 | OE | 3, 4, 8 | P1510 | + | wt | B |

TABLE 15-continued

GIDs identified as conferring shade tolerance under low R:FR conditions

| GID | Gene family | OE/KO | Lines tested | PID of OEX construct | Shade tolerance phenotype[1] | Growth under white light[2] | Priority Ranking[3] |
|---|---|---|---|---|---|---|---|
| G988 | SCR | OE | 21, 23, 25 | P1475 | + | – | B |
| G1062 | HLH/MYC | KO | KO | NA | + | wt | B |
| G1069 | AT-hook | OE | 41, 42, 64 | P1178 | + | wt | B |
| G1129 | HLH/MYC | OE | 2, 10, 16 | P1298 | + | – | B |
| G1137 | HLH/MYC | OE | 1, 14, 15 | P938 | + | wt | B |
| G1425 | NAC | OE | 22, 27, 28 | P1361 | + | – | B |
| G1517 | RING/C3HC4 | OE | 1, 2, 3 | P1096 | + | – | B |
| G1655 | HLH/MYC | OE | 10, 14, 19 | P1008 | + | – | B |
| G1743 | RING/C3H2C3 | OE | 1, 5, 7 | P15028 | + | – | B |
| G1789 | MYB-related | OE | 5, 11, 19 | P1562 | + | wt | B |
| G1806 | bZIP | OE | 3, 6, 8 | P1559 | + | wt | B |
| G1911 | MYB-related | OE | 4, 5, 6 | P989 | + | – | B |
| G2011 | HS | OE | 5, 12, 18 | P1813 | + | – | B |
| G2155 | AT-hook | OE | 2, 8, 12 | P1742 | + | wt | B |
| G2215 | bZIP-NIN | OE | 3, 5, 7 | P1948 | + | wt | B |
| G2452 | MYB-related | OE | 7, 11, 16 | P2023 | + | wt | B |
| G2455 | YABBY | OE | 8, 11, 17 | P2584 | + | wt | B |
| G2510 | AP2 | OE | 12, 14, 20 | P2038 | + | wt | B |
| G2515 | MADS | OE | 5, 41, 45 | P13372 | + | wt | B |
| G2571 | AP2 | OE | 1, 5, 8 | P1998 | + | wt | B |
| G2702 | MYB-(R1)R2R3 | OE | 23, 29, 31 | P13807 | + | wt | B |
| G2763 | HLH/MYC | OE | 1, 2, 5 | P2387 | + | – | B |
| G2774 | HLH/MYC | OE | 12, 15, 18 | P16177 | + | wt | B |
| G2888 | Z-C2H2 | OE | 21, 24, 27 | P2656 | + | – | B |
| G2958 | IAA | OE | 22, 26, 30 | P15168 | + | wt | B |

Table 15 Notes.
All scores presented in Table 15 (other than wild type) were based on data from two independent experiments on the seed batches (assuming sufficient seed was available to repeat the experiment twice).
[1]"Shade tolerance phenotype" column. Score of "++" indicates a strong suppression of shade responses; the phenotype was very consistent and growth was significantly above the normal levels of variability observed for the assay. Score of "+" in the indicates a mild/moderate suppression of shade responses; the response was consistent but was only moderately above the normal levels of variability observed for the assay
[2]"Growth under white light" column. A score of "–" indicates that the seedlings from that line were generally smaller than wild-type controls under normal, white light conditions. A score of "+" indicates that the seedlings from that line were generally slightly larger than controls under normal conditions. A score of "wt" indicates that the seedlings were normal under such conditions.
[3] GIDs which are considered top hits and have been confirmed in multiple experiments are given an A ranking. GIDs that are considered potential leads but require confirmation in follow-up studies are given a B ranking. The "A" and "B" rankings are not meant to be construed as an indication of the relative value and potential utility of these candidate sequences, but represent the degree of testing completeness.

Example XI: Identification of Homologous Sequences

This example describes identification of genes that are orthologous to *Arabidopsis thaliana* transcription factors from a computer homology search.

Homologous sequences, including those of paralogs and orthologs from *Arabidopsis* and other plant species, were identified using database sequence search tools, such as the Basic Local Alignment Search Tool (BLAST) (Altschul et al. (1990) supra; and Altschul et al. (1997) *Nucleic Acid Res.* 25: 3389-3402). The tblastx sequence analysis programs were employed using the BLOSUM-62 scoring matrix (Henikoff and Henikoff (1992) *Proc. Natl. Acad. Sci.* 89: 10915-10919). The entire NCBI GenBank database was filtered for sequences from all plants except *Arabidopsis thaliana* by selecting all entries in the NCBI GenBank database associated with NCBI taxonomic ID 33090 (Viridiplantae; all plants) and excluding entries associated with taxonomic ID 3701 (*Arabidopsis thaliana*).

These sequences are compared to sequences representing genes of the invention, for example, polynucleotides found in the Sequence Listing, using the Washington University TBLASTX algorithm (version 2.0a19MP) at the default settings using gapped alignments with the filter "off". For each polynucleotide sequence found in the Sequence Listing, individual comparisons were ordered by probability score (P-value), where the score reflects the probability that a particular alignment occurred by chance. For example, a score of 3.6E-40 is 3.6×10-40. In addition to P-values, comparisons were also scored by percentage identity. Percentage identity reflects the degree to which two segments of DNA or protein are identical over a particular length. Examples of sequences so identified are presented in Tables 8 and 9. The percent sequence identity among these sequences can be as low as 47%, or even lower sequence identity.

Candidate paralogous sequences were identified among *Arabidopsis* transcription factors through alignment, identity, and phylogenic relationships. Candidate orthologous sequences were identified from proprietary unigene sets of plant gene sequences in *Zea mays, Glycine max* and *Oryza sativa* based on significant homology to *Arabidopsis* transcription factors. These candidates were reciprocally compared to the set of *Arabidopsis* transcription factors. If the candidate showed maximal similarity in the protein domain to the eliciting transcription factor or to a paralog of the eliciting transcription factor, then it was considered to be an ortholog. Identified non-*Arabidopsis* sequences that were shown in this manner to be orthologous to the *Arabidopsis* sequences are provided in Tables 8 and 9.

Example XII: Screen of Plant cDNA Library for Sequence Encoding a Transcription Factor DNA Binding Domain that Binds to a Transcription Factor Binding Promoter Element and Demonstration of Protein Transcription Regulation Activity The "one-hybrid" strategy (Li and Herskowitz (1993) Science 262: 1870-1874) is used to screen for plant cDNA clones encoding a polypeptide comprising a transcription factor DNA binding domain, a conserved domain. In brief, yeast strains are constructed that contain a lacZ reporter gene with either wild-type or mutant transcription factor binding promoter element sequences in place of the normal UAS (upstream activator sequence) of the GAL4 promoter. Yeast reporter strains are constructed that carry transcription factor binding promoter element sequences as UAS elements are operably linked upstream (5') of a lacZ reporter gene with a minimal GAL4 promoter. The strains are transformed with a plant expression library that contains random cDNA inserts fused to the GAL4 activation domain (GAL4-ACT) and screened for blue colony formation on X-gal-treated filters (X-gal: 5-bromo-4-chloro-3-indolyl-β-D-galactoside; Invitrogen Corporation, Carlsbad Calif.). Alternatively, the strains are transformed with a cDNA polynucleotide encoding a known transcription factor DNA binding domain polypeptide sequence.

Yeast strains carrying these reporter constructs produce low levels of β-galactosidase and form white colonies on filters containing X-gal. The reporter strains carrying wild-type transcription factor binding promoter element sequences are transformed with a polynucleotide that encodes a polypeptide comprising a plant transcription factor DNA binding domain operably linked to the acidic activator domain of the yeast GAL4 transcription factor, "GAL4-ACT". The clones that contain a polynucleotide encoding a transcription factor DNA binding domain operably linked to GAL4-ACT can bind upstream of the lacZ reporter genes carrying the wild-type transcription factor binding promoter element sequence, activate transcription of the lacZ gene and result in yeast forming blue colonies on X-gal-treated filters.

Upon screening about $2 \times 10^6$ yeast transformants, positive cDNA clones are isolated; i.e., clones that cause yeast strains carrying lacZ reporters operably linked to wild-type transcription factor binding promoter elements to form blue colonies on X-gal-treated filters. The cDNA clones do not cause a yeast strain carrying a mutant type transcription factor binding promoter elements fused to LacZ to turn blue. Thus, a polynucleotide encoding transcription factor DNA binding domain, a conserved domain, is shown to activate transcription of a gene.

Example XIII: Gel Shift Assays

The presence of a transcription factor comprising a DNA binding domain which binds to a DNA transcription factor binding element is evaluated using the following gel shift assay. The transcription factor is recombinantly expressed and isolated from E. coli or isolated from plant material. Total soluble protein, including transcription factor, (40 ng) is incubated at room temperature in 10 µl of 1× binding buffer (15 mM HEPES (pH 7.9), 1 mM EDTA, 30 mM KCl, 5% glycerol, 5% bovine serum albumin, 1 mM DTT) plus 50 ng poly(dI-dC):poly(dI-dC) (Pharmacia, Piscataway N.J.) with or without 100 ng competitor DNA. After 10 minutes incubation, probe DNA comprising a DNA transcription factor binding element (1 ng) that has been $^{32}$P-labeled by end-filling (Sambrook et al. supra) is added and the mixture incubated for an additional 10 minutes. Samples are loaded onto polyacrylamide gels (4% w/v) and fractionated by electrophoresis at 150V for 2 h (Sambrook et al. supra). The degree of transcription factor-probe DNA binding is visualized using autoradiography. Probes and competitor DNAs are prepared from oligonucleotide inserts ligated into the BamHI site of pUC118 (Vieira et al. (1987) Methods Enzymol. 153: 3-11). Orientation and concatenation number of the inserts are determined by dideoxy DNA sequence analysis (Sambrook et al. supra). Inserts are recovered after restriction digestion with EcoRI and HindIII and fractionation on polyacrylamide gels (12% w/v) (Sambrook et al. supra).

Example XIV: Transformation of Dicots

Crop species overexpressing members of the G1792 clade of transcription factor polypeptides have been shown experimentally to produce plants with increased tolerance to disease. This observation indicates that these genes, when overexpressed, will result in larger yields of various plant species, particularly during conditions of biotic stress.

Thus, transcription factor sequences listed in the Sequence Listing recombined into pMEN20 or pMEN65 expression vectors may be transformed into a plant for the purpose of modifying plant traits. The cloning vector may be introduced into a variety of cereal plants by means well known in the art such as, for example, direct DNA transfer or Agrobacterium tumefaciens-mediated transformation. It is now routine to produce transgenic plants using most dicot plants (see Weissbach and Weissbach, (1989) supra; Gelvin et al. (1990) supra; Herrera-Estrella et al. (1983) supra; Bevan (1984) supra; and Klee (1985) supra). Methods for analysis of traits are routine in the art and examples are disclosed above.

Methods for transforming cotton may be found in U.S. Pat. Nos. 5,004,863, 5,159,135 and 5,518,908; for transforming brassica species may be found in U.S. Pat. No. 5,463,174; for transforming peanut plants may be found in Cheng et al. (1996) Plant Cell Rep. 15: 653-657, and McKently et al. (1995) Plant Cell Rep. 14: 699-703; and for transforming pea may be found in Grant et al. (1995) Plant Cell Rep. 15: 254-258.

Numerous protocols for the transformation of tomato and soy plants have been previously described, and are well known in the art. Gruber et al. ((1993) in Methods in Plant Molecular Biology and Biotechnology, p. 89-119, Glick and Thompson, eds., CRC Press, Inc., Boca Raton) describe several expression vectors and culture methods that may be used for cell or tissue transformation and subsequent regeneration. For soybean transformation, methods are described by Miki et al. (1993) in Methods in Plant Molecular Biology and Biotechnology, p. 67-88, Glick and Thompson, eds., CRC Press, Inc., Boca Raton; and U.S. Pat. No. 5,563,055, (Townsend and Thomas), issued Oct. 8, 1996.

There are a substantial number of alternatives to Agrobacterium-mediated transformation protocols, other methods for the purpose of transferring exogenous genes into soybeans or tomatoes. One such method is microprojectile-mediated transformation, in which DNA on the surface of microprojectile particles is driven into plant tissues with a biolistic device (see, for example, Sanford et al., (1987) Part. Sci. Technol. 5:27-37; Christou et al. (1992) Plant. J. 2: 275-281; Sanford (1993) Methods Enzymol. 217: 483-509; Klein et al. (1987) Nature 327: 70-73; U.S. Pat. No.

5,015,580 (Christou et al), issued May 14, 1991; and U.S. Pat. No. 5,322,783 (Tomes et al.), issued Jun. 21, 1994.

Alternatively, sonication methods (see, for example, Zhang et al. (1991) *Bio/Technology* 9: 996-997); direct uptake of DNA into protoplasts using CaCl2 precipitation, polyvinyl alcohol or poly-L-ornithine (see, for example, Hain et al. (1985) *Mol. Gen. Genet.* 199: 161-168; Draper et al., *Plant Cell Physiol.* 23: 451-458 (1982)); liposome or spheroplast fusion (see, for example, Deshayes et al. (1985) *EMBO J.*, 4: 2731-2737; Christou et al. (1987) *Proc. Natl. Acad. Sci.* USA 84: 3962-3966); and electroporation of protoplasts and whole cells and tissues (see, for example, Donn et al. (1990) in *Abstracts of VIIth International Congress on Plant Cell and Tissue Culture IAPTC*, A2-38: 53; D'Halluin et al. (1992) *Plant Cell* 4: 1495-1505; and Spencer et al. (1994) *Plant Mol. Biol.* 24: 51-61) have been used to introduce foreign DNA and expression vectors into plants.

After a plant or plant cell is transformed (and the latter regenerated into a plant), the transformed plant may be crossed with itself or a plant from the same line, a non-transformed or wild-type plant, or another transformed plant from a different transgenic line of plants. Crossing provides the advantages of producing new and often stable transgenic varieties. Genes and the traits they confer that have been introduced into a tomato or soybean line may be moved into distinct line of plants using traditional backcrossing techniques well known in the art. Transformation of tomato plants may be conducted using the protocols of Koornneef et al (1986) In *Tomato Biotechnology*: Alan R. Liss, Inc., 169-178, and in U.S. Pat. No. 6,613,962, the latter method described in brief here. Eight day old cotyledon explants are precultured for 24 hours in Petri dishes containing a feeder layer of *Petunia hybrida* suspension cells plated on MS medium with 2% (w/v) sucrose and 0.8% agar supplemented with 10 µM α-naphthalene acetic acid and 4.4 µM 6-benzylaminopurine. The explants are then infected with a diluted overnight culture of *Agrobacterium tumefaciens* containing an expression vector comprising a polynucleotide of the invention for 5-10 minutes, blotted dry on sterile filter paper and cocultured for 48 hours on the original feeder layer plates. Culture conditions are as described above. Overnight cultures of *Agrobacterium tumefaciens* are diluted in liquid MS medium with 2% (w/v/) sucrose, pH 5.7) to an $OD_{600}$ of 0.8.

Following cocultivation, the cotyledon explants are transferred to Petri dishes with selective medium comprising MS medium with 4.56 µM zeatin, 67.3 µM vancomycin, 418.9 µM cefotaxime and 171.6 µM kanamycin sulfate, and cultured under the culture conditions described above. The explants are subcultured every three weeks onto fresh medium. Emerging shoots are dissected from the underlying callus and transferred to glass jars with selective medium without zeatin to form roots. The formation of roots in a kanamycin sulfate-containing medium is a positive indication of a successful transformation.

Transformation of soybean plants may be conducted using the methods found in, for example, U.S. Pat. No. 5,563,055. In this method, soybean seed is surface sterilized by exposure to chlorine gas evolved in a glass bell jar. Seeds are germinated by plating on 1/10 strength agar solidified medium without plant growth regulators and culturing at 28° C. with a 16 hour day length. After three or four days, seed may be prepared for cocultivation. The seedcoat is removed and the elongating radicle removed 3-4 mm below the cotyledons.

Overnight cultures of *Agrobacterium tumefaciens* harboring the expression vector comprising a polynucleotide of the invention are grown to log phase, pooled, and concentrated by centrifugation. Inoculations are conducted in batches such that each plate of seed was treated with a newly resuspended pellet of *Agrobacterium*. The pellets are resuspended in 20 ml inoculation medium. The inoculum is poured into a Petri dish containing prepared seed and the cotyledonary nodes are macerated with a surgical blade. After 30 minutes the explants are transferred to plates of the same medium that has been solidified. Explants are embedded with the adaxial side up and level with the surface of the medium and cultured at 22° C. for three days under white fluorescent light. These plants may then be regenerated according to methods well established in the art, such as by moving the explants after three days to a liquid counter-selection medium (see U.S. Pat. No. 5,563,055).

The explants may then be picked, embedded and cultured in solidified selection medium. After one month on selective media transformed tissue becomes visible as green sectors of regenerating tissue against a background of bleached, less healthy tissue. Explants with green sectors are transferred to an elongation medium. Culture is continued on this medium with transfers to fresh plates every two weeks. When shoots are 0.5 cm in length they may be excised at the base and placed in a rooting medium.

Example XV: Altered C/N Sensing and Increased Shade and Abiotic Stress Tolerance in Monocots Cereal plants such as, but not limited to, corn, wheat, rice, *sorghum*, or barley, may be transformed with the present polynucleotide sequences, including monocot or dicot-derived sequences such as those presented in Tables 1, 3, 8 or 9, cloned into a vector such as pGA643 and containing a kanamycin-resistance marker, and expressed constitutively under, for example, the CaMV 35S or COR15 promoters. pMEN20 or pMEN65 and other expression vectors may also be used for the purpose of modifying plant traits. For example, pMEN020 may be modified to replace the NptII coding region with the BAR gene of *Streptomyces hygroscopicus* that confers resistance to phosphinothricin. The KpnI and BglII sites of the Bar gene are removed by site-directed mutagenesis with silent codon changes.

The cloning vector may be introduced into a variety of cereal plants by means well known in the art including direct DNA transfer or *Agrobacterium tumefaciens*-mediated transformation. The latter approach may be accomplished by a variety of means, including, for example, that of U.S. Pat. No. 5,591,616, in which monocotyledon callus is transformed by contacting dedifferentiating tissue with the *Agrobacterium* containing the cloning vector.

The sample tissues are immersed in a suspension of $3 \times 10^{-9}$ cells of *Agrobacterium* containing the cloning vector for 3-10 minutes. The callus material is cultured on solid medium at 25° C. in the dark for several days. The calli grown on this medium are transferred to Regeneration medium. Transfers are continued every 2-3 weeks (2 or 3 times) until shoots develop. Shoots are then transferred to Shoot-Elongation medium every 2-3 weeks. Healthy looking shoots are transferred to rooting medium and after roots have developed, the plants are placed into moist potting soil.

The transformed plants are then analyzed for the presence of the NPTII gene/kanamycin resistance by ELISA, using the ELISA NPTII kit from 5Prime-3Prime Inc. (Boulder, Colo.).

It is also routine to use other methods to produce transgenic plants of most cereal crops (Vasil (1994) *Plant Mol. Biol.* 25: 925-937) such as corn, wheat, rice, *sorghum* (Cassas et al. (1993) *Proc. Natl. Acad. Sci.* USA 90: 11212-11216, and barley (Wan and Lemeaux (1994) *Plant Physiol.* 104:37-48). DNA transfer methods such as the microprojectile method can be used for corn (Fromm et al. (1990) *Bio/Technol.* 8: 833-839); Gordon-Kamm et al. (1990) *Plant Cell* 2: 603-618; Ishida (1990) *Nature Biotechnol.* 14:745-750), wheat (Vasil et al. (1992) *Bio/Technol.* 10:667-674; Vasil et al. (1993) *Bio/Technol.* 11:1553-1558; Weeks et al. (1993) *Plant Physiol.* 102:1077-1084), and rice (Christou (1991) *Bio/Technol.* 9:957-962; Hiei et al. (1994) *Plant J.* 6:271-282; Aldemita and Hodges (1996) *Planta* 199:612-617; and Hiei et al. (1997) *Plant Mol. Biol.* 35:205-218). For most cereal plants, embryogenic cells derived from immature scutellum tissues are the preferred cellular targets for transformation (Hiei et al. (1997) *Plant Mol. Biol.* 35:205-218; Vasil (1994) *Plant Mol. Biol.* 25: 925-937). For transforming corn embryogenic cells derived from immature scutellar tissue using microprojectile bombardment, the A188XB73 genotype is the preferred genotype (Fromm et al. (1990) *Bio/Technol.* 8: 833-839; Gordon-Kamm et al. (1990) *Plant Cell* 2: 603-618). After microprojectile bombardment the tissues are selected on phosphinothricin to identify the transgenic embryogenic cells (Gordon-Kamm et al. (1990) *Plant Cell* 2: 603-618). Transgenic plants are regenerated by standard corn regeneration techniques (Fromm et al. (1990) *Bio/Technol.* 8: 833-839; Gordon-Kamm et al. (1990) *Plant Cell* 2: 603-618).

Northern blot analysis, RT-PCR or microarray analysis of the regenerated, transformed plants may be used to show expression of G1792 and related genes that are capable of conferring tolerance to biotic or abiotic stress.

To verify the ability to confer abiotic stress tolerance, mature plants overexpressing a transcription factor of the invention, or alternatively, seedling progeny of these plants, may be challenged in an abiotic stress assay, such as a drought, heat, high salt, or freezing assay, in an osmotic stress condition that may also measure altered sugar sensing, such as a high sugar condition, in a shade tolerance assay, or in a C/N sensing assay to identify plants with altered stress or shade tolerance of altered C/N sensing. By comparing wild type and transgenic plants similarly treated, the transgenic plants may be shown to have greater tolerance to abiotic stress.

After a monocot plant or plant cell has been transformed (and the latter regenerated into a plant) and shown to have greater tolerance to biotic or abiotic stress, or produce greater yield relative to a control plant under the stress conditions, the transformed monocot plant may be crossed with itself or a plant from the same line, a non-transformed or wild-type monocot plant, or another transformed monocot plant from a different transgenic line of plants.

Example XVI: Genes that Confer Significant Improvements to Non-*Arabidopsis* Species The function of specific orthologs of transcription factors of the invention has been analyzed and may be further characterized by incorporation into crop plants. The function of specific orthologs of the sequences in the Sequence Listing may be analyzed through their altered expression (e.g., ectopic overexpression, or knocking out) in plants, using constitutive, inducible, or tissue specific regulatory elements, as disclosed above. These sequences include polynucleotide sequences found in the Sequence Listing such as, for example:

(i) those sequences conferring drought tolerance found in *Arabidopsis thaliana* SEQ ID NO: 2 (G47) and SEQ ID NO: 12 (G2133); *Oryza sativa* (*japonica* cultivar-group) SEQ ID NO: 98 (G3649), SEQ ID NO: 100 (G3651), and SEQ ID NO: 90 (G3644); *Glycine max* SEQ ID NO: 88 (G3643); *Zinnia elegans* SEQ ID NO: 96 (G3647); *Brassica rapa* subsp. *Pekinensis* SEQ ID NO: 92 (G3645); and *Brassica oleracea* SEQ ID NO: 94 (G3646);

(ii) those sequences conferring altered C/N sensing found in *Arabidopsis thaliana* SEQ ID NO: 234, 286, 312, and 32 (G682, G226, G1816, and G2718; *Oryza sativa* SEQ ID NO: 326 and 328 (G3392 and G3393); *Glycine max* SEQ ID NO: 372, 374, 376, 378, 380, and 382 (G3445, G3446, G3447, G3448, G3449, and G3450); and *Zea mays* SEQ ID NO: 360 and 370 (G3431 and G3444); and (iii) those sequences conferring shade tolerance found in *Arabidopsis thaliana* SEQ ID NO: 232 (G634), SEQ ID NO: 818 (G2505), and SEQ ID NO: 248 (G2789), and G2789 orthologs in *Glycine max* (Gma_S4935598) and *Pinus taeda* (Pta_S15799222, Pta_S16786360, Pta_S16788492, and Pta_S16802054).

The polynucleotide and polypeptide sequences derived from monocots may be used to transform both monocot and dicot plants, and those derived from dicots may be used to transform either group, although some of these sequences will function best if the gene is transformed into a plant from the same group as that from which the sequence is derived.

Transformation procedures are provided in these Examples, and may employ the use of an expression vector. After the vector is introduced into a plant cell, a plant may be regenerated from the cell, after which the plant is allowed to overexpress one of the polypeptides of the invention that have the property of increasing abiotic stress tolerance, shade tolerance, or altered C/N sensing in the transgenic plant. Plants with these altered traits may be identified by comparison with wild-type or non-transformed plants that do not overexpress the polypeptide, after which one or more plant with a desirable degree of one or more improved traits may be selected. In this manner, plants with enhanced shade tolerance, increased abiotic stress tolerance, altered C/N sensing, or more than one of these altered traits may be selected.

For drought tolerance-related analysis, seeds of these transgenic plants are subjected to germination assays to measure sucrose sensing. Sterile monocot seeds, including, but not limited to, corn, rice, wheat, rye and *sorghum*, as well as dicots including, but not limited to soybean and alfalfa, are sown on 80% MS medium plus vitamins with 9.4% sucrose; control media lack sucrose. All assay plates are then incubated at 22° C. under 24-hour light, 120-130 μEin/m$^2$/s, in a growth chamber. Evaluation of germination and seedling vigor is then conducted three days after planting. Overexpressors of these sequences may be found to be more tolerant to high sucrose by having better germination, longer radicles, and more cotyledon expansion. These results would indicate that overexpressors of the orthologs in the Sequence Listing are involved in sucrose-specific sugar sensing.

Plants overexpressing these orthologs may also be subjected to soil-based drought assays to identify those lines that are more tolerant to water deprivation than wild-type control plants. Generally, ortholog overexpressing plants will appear significantly larger and greener, with less wilting or desiccation, than wild-type controls plants, particularly after a period of water deprivation is followed by rewatering and a subsequent incubation period.

For C/N sensing-related analysis, seeds of these transgenic plants are subjected to germination or growth assays to measure C/N sensing or tolerance to low nitrogen. Sterilized monocot seeds, including, but not limited to, corn, rice, wheat, rye and *sorghum*, as well as dicots including, but not limited to soybean and alfalfa, are sown on basal media comprising 80% MS+Vitamins.

The sterile seeds sown onto plates containing media based on 80% MS without a nitrogen source. For C/N assays, the media contains 3% sucrose. The −N/+Gln media the same media, supplemented with 1 mM glutamine, is used. Plates are incubated in a 24-hour light C (120-130 µEins$^{-2}$ m$^{-1}$) growth chamber at 22° C. Evaluation of germination and seedling vigor is performed five days after planting. Overexpressors of these genes that are more tolerant to low nitrogen than control plants have better germination, longer radicles, more cotyledon expansion, more root hairs, greater root mass, more vegetative growth, a greener appearance, or less anthocyanin. The latter (production of less anthocyanin on these media) is generally associated with increased tolerance to nitrogen limitation.

A transgene responsible for the altered response is likely involved in the plant's ability to perceive their carbon and nitrogen status.

For shade tolerance-related analysis, seeds of these transgenic plants are subjected to germination or growth assays to measure shade tolerance. Sterilized monocot seeds, including, but not limited to, corn, rice, wheat, rye and *sorghum*, as well as dicots including, but not limited to soybean and alfalfa, are sown on 80% MS medium plus vitamins. Plates are incubated at 22° C. under 24-hour light (about 50 µEinsteins$^{-2}$ m$^{-1}$) under both white light (control) and under light depleted in red wavelengths. Seedlings are then assessed for shade tolerance at 7 days, and shade tolerance is scored by visually observing differences in hypocotyl length compared with control seedlings grown under white light and grown under light lacking the red wavelengths.

Overexpressors of these sequences may be found to be more tolerant to low light by having altered morphological characteristics associated with a shade tolerant phenotype, or improved growth or yield in conditions of low light. Overexpressors of these genes may also be found to be more tolerant to shade or abiotic stresses, and may show altered cotyledon, altered hypocotyl, altered leaf orientation, altered petiole, and/or constitutive photomorphogenesis, better germination, longer radicles, more cotyledon expansion, more vegetative growth, a greener appearance, or less anthocyanin in stress conditions. These results would indicate that overexpressors of the orthologs in the Sequence Listing are involved in shade tolerance responses.

Plants overexpressing these orthologs may also be subjected to low light or abiotic stress assays to identify those lines that are more tolerant to low light conditions or abiotic stresses than wild-type control plants in these conditions. Generally, ortholog overexpressing plants will show morphological features that are associated with a shade avoidance phenotype (e.g., altered cotyledon, altered hypocotyl, altered leaf orientation, altered petiole, and/or constitutive photomorphogenesis), and may also appear larger, greener, and healthier than wild-type controls plants.

Example XVII: Identification of Orthologous and Paralogous Sequences

Orthologs to *Arabidopsis* genes may identified by several methods, including hybridization, amplification, or bioinformatically. This example describes how one may identify homologs to the *Arabidopsis* AP2 family transcription factor CBF1, which confers tolerance to abiotic stresses (Thomashow et al. (2002) U.S. Pat. No. 6,417,428), and an example to confirm the function of homologous sequences. In this example, orthologs to CBF1 were found in canola (*Brassica napus*) using polymerase chain reaction (PCR).

Degenerate primers were designed for regions of AP2 binding domain and outside of the AP2 (carboxyl terminal domain; U.S. Pat. No. 6,417,428):

```
                                        (SEQ ID NO: 1437)
Mol 368       5'-CAY CCN ATH TAY MGN GGN GT-3'
(reverse)

(SEQ ID NO: 1438)
Mol 378       5'-GGN ARN ARC ATN CCY TCN GCC-3'
(forward)
(Y: C/T, N: A/C/G/T, H: A/C/T, M: A/C, R: A/G)
```

Primer Mol 368 is in the AP2 binding domain of CBF1 (amino acid sequence: His-Pro-Ile-Tyr-Arg-Gly-Val; SEQ ID NO: 1439) while primer Mol 378 is outside the AP2 domain (carboxyl terminal domain) (amino acid sequence: Met-Ala-Glu-Gly-Met-Leu-Leu-Pro; SEQ ID NO: 1440).

The genomic DNA isolated from *B. napus* was PCR-amplified by using these primers following these conditions: an initial denaturation step of 2 min at 93° C.; 35 cycles of 93° C. for 1 min, 55° C. for 1 min, and 72° C. for 1 min; and a final incubation of 7 min at 72° C. at the end of cycling.

The PCR products were separated by electrophoresis on a 1.2% agarose gel and transferred to nylon membrane and hybridized with the AT CBF1 probe prepared from *Arabidopsis* genomic DNA by PCR amplification. The hybridized products were visualized by colorimetric detection system (Boehringer Mannheim) and the corresponding bands from a similar agarose gel were isolated using the Qiagen Extraction Kit (Qiagen). The DNA fragments were ligated into the TA clone vector from TOPO TA Cloning Kit (Invitrogen) and transformed into *E. coli* strain TOP10 (Invitrogen).

Seven colonies were picked and the inserts were sequenced on an ABI 377 machine from both strands of sense and antisense after plasmid DNA isolation. The DNA sequence was edited by sequencer and aligned with the AtCBF1 by GCG software and NCBI blast searching.

The nucleic acid sequence and amino acid sequence of one canola ortholog found in this manner (bnCBF1; U.S. Pat. No. 6,417,428) identified by this process is shown in the Sequence Listing.

The aligned amino acid sequences show that the bnCBF1 gene has 88% identity with the *Arabidopsis* sequence in the AP2 domain region and 85% identity with the *Arabidopsis* sequence outside the AP2 domain when aligned for two insertion sequences that are outside the AP2 domain.

Similarly, paralogous sequences to *Arabidopsis* genes, such as CBF1, may also be identified.

Two paralogs of CBF1 from *Arabidopsis thaliana*: CBF2 and CBF3. CBF2 and CBF3 have been cloned and sequenced as described below. The sequences of the DNA and encoded proteins are set forth in U.S. Pat. No. 6,417,428.

A lambda cDNA library prepared from RNA isolated from *Arabidopsis thaliana* ecotype Columbia (Lin and Thomashow (1992) *Plant Physiol*. 99: 519-525) was screened for recombinant clones that carried inserts related to the CBF1 gene (Stockinger et al. (1997) *Proc. Natl. Acad. Sci.* 94:1035-1040). CBF1 was $^{32}$P-radiolabeled by random priming (Sambrook et al. supra) and used to screen the library by the plaque-lift technique using standard stringent hybridization and wash conditions (Hajela et al. (1990) *Plant Physiol.* 93:1246-1252; Sambrook et al. supra) 6×SSPE buffer, 60° C. for hybridization and 0.1×SSPE buffer and 60° C. for washes). Twelve positively hybridizing clones were obtained and the DNA sequences of the cDNA inserts were determined. The results indicated that the clones fell into three classes. One class carried inserts corresponding to CBF1. The two other classes carried sequences corresponding to two different homologs of CBF1, designated CBF2 and CBF3. The nucleic acid sequences and predicted protein coding sequences for *Arabidopsis* CBF1, CBF2, CBF3, and the *Brassica napus* CBF ortholog are set forth in U.S. Pat. No. 6,417,428.

A comparison of the nucleic acid sequences of *Arabidopsis* CBF1, CBF2 and CBF3 indicate that they are 83 to 85% identical as shown in Table 16.

TABLE 16

| | Percent identity[a] | |
|---|---|---|
| | DNA[b] | Polypeptide |
| cbf1/cbf2 | 85 | 86 |
| cbf1/cbf3 | 83 | 84 |
| cbf2/cbf3 | 84 | 85 |

[a]Percent identity was determined using the Clustal algorithm from the MEGALIGN program (DNASTAR, Inc.).
[b]Comparisons of the nucleic acid sequences of the open reading frames are shown.

Similarly, the amino acid sequences of the three CBF polypeptides range from 84 to 86% identity. An alignment of the three amino acid sequences reveals that most of the differences in amino acid sequence occur in the acidic C-terminal half of the polypeptide. This region of CBF1 serves as an activation domain in both yeast and *Arabidopsis* (not shown).

Residues 47 to 106 of CBF1 correspond to the AP2 domain of the protein, a DNA binding motif that to date, has only been found in plant proteins. A comparison of the AP2 domains of CBF1, CBF2 and CBF3 indicates that there are a few differences in amino acid sequence. These differences in amino acid sequence might have an effect on DNA binding specificity.

Example XVIII: Transformation of Canola with a Plasmid Containing CBF1, CBF2, or CBF3

After identifying homologous genes to CBF1, canola was transformed with a plasmid containing the *Arabidopsis* CBF1, CBF2, or CBF3 genes cloned into the vector pGA643 (An (1987) *Methods Enzymol.* 253: 292). In these constructs the CBF genes were expressed constitutively under the CaMV 35S promoter. In addition, the CBF1 gene was cloned under the control of the *Arabidopsis* COR15 promoter in the same vector pGA643. Each construct was transformed into *Agrobacterium* strain GV3101. Transformed Agrobacteria were grown for 2 days in minimal AB medium containing appropriate antibiotics.

Spring canola (*B. napus* cv. Westar) was transformed using the protocol of Moloney et al. ((1989) *Plant Cell Reports* 8: 238) with some modifications as described. Briefly, seeds were sterilized and plated on half strength MS medium, containing 1% sucrose. Plates were incubated at 24° C. under 60-80 µE/m² s light using a 16 hour light/8 hour dark photoperiod. Cotyledons from 4-5 day old seedlings were collected, the petioles cut and dipped into the *Agrobacterium* solution. The dipped cotyledons were placed on co-cultivation medium at a density of 20 cotyledons/plate and incubated as described above for 3 days. Explants were transferred to the same media, but containing 300 mg/l timentin (SmithKline Beecham, Pa.) and thinned to 10 cotyledons/plate. After 7 days explants were transferred to Selection/Regeneration medium. Transfers were continued every 2-3 weeks (2 or 3 times) until shoots had developed. Shoots were transferred to Shoot-Elongation medium every 2-3 weeks. Healthy looking shoots were transferred to rooting medium. Once good roots had developed, the plants were placed into moist potting soil.

The transformed plants were then analyzed for the presence of the NPTII gene/kanamycin resistance by ELISA, using the ELISA NPTII kit from 5Prime-3Prime Inc. (Boulder, Colo.). Approximately 70% of the screened plants were NPTII positive. Only those plants were further analyzed.

From Northern blot analysis of the plants that were transformed with the constitutively expressing constructs, showed expression of the CBF genes and all CBF genes were capable of inducing the *Brassica napus* cold-regulated gene BN115 (homolog of the *Arabidopsis* COR15 gene). Most of the transgenic plants appear to exhibit a normal growth phenotype. As expected, the transgenic plants are more freezing tolerant than the wild-type plants. Using the electrolyte leakage of leaves test, the control showed a 50% leakage at −2 to −3° C. Spring canola transformed with either CBF1 or CBF2 showed a 50% leakage at −6 to −7° C. Spring canola transformed with CBF3 shows a 50% leakage at about −10 to −15° C. Winter canola transformed with CBF3 may show a 50% leakage at about −16 to −20° C. Furthermore, if the spring or winter canola are cold acclimated the transformed plants may exhibit a further increase in freezing tolerance of at least −2° C.

To test salinity tolerance of the transformed plants, plants were watered with 150 mM NaCl. Plants overexpressing CBF1, CBF2 or CBF3 grew better compared with plants that had not been transformed with CBF1, CBF2 or CBF3.

These results demonstrate that homologs of *Arabidopsis* transcription factors can be identified and shown to confer similar functions in non-*Arabidopsis* plant species.

Example IXX: Cloning of Transcription Factor Promoters

Promoters are isolated from transcription factor genes that have gene expression patterns useful for a range of applications, as determined by methods well known in the art (including transcript profile analysis with cDNA or oligonucleotide microarrays, Northern blot analysis, semi-quantitative or quantitative RT-PCR). Interesting gene expression profiles are revealed by determining transcript abundance for a selected transcription factor gene after exposure of plants to a range of different experimental conditions, and in a range of different tissue or organ types, or developmental stages. Experimental conditions to which plants are exposed for this purpose includes cold, heat, drought, osmotic challenge, varied hormone concentrations (ABA, GA, auxin, cytokinin, salicylic acid, brassinosteroid), pathogen and pest challenge. The tissue types and developmental stages include stem, root, flower, rosette leaves, cauline leaves, siliques, germinating seed, and meristematic tissue. The set of expression levels provides a pattern that is determined by the regulatory elements of the gene promoter.

Transcription factor promoters for the genes disclosed herein are obtained by cloning 1.5 kb to 2.0 kb of genomic sequence immediately upstream of the translation start codon for the coding sequence of the encoded transcription factor protein. This region includes the 5'-UTR of the transcription factor gene, which can comprise regulatory elements. The 1.5 kb to 2.0 kb region is cloned through PCR methods, using primers that include one in the 3' direction located at the translation start codon (including appropriate adaptor sequence), and one in the 5' direction located from 1.5 kb to 2.0 kb upstream of the translation start codon (including appropriate adaptor sequence). The desired fragments are PCR-amplified from *Arabidopsis* Col-0 genomic DNA using high-fidelity Taq DNA polymerase to minimize the incorporation of point mutation(s). The cloning primers incorporate two rare restriction sites, such as Not1 and Sfi1, found at low frequency throughout the *Arabidopsis* genome. Additional restriction sites are used in the instances where a Not1 or Sfi1 restriction site is present within the promoter.

The 1.5-2.0 kb fragment upstream from the translation start codon, including the 5'-untranslated region of the transcription factor, is cloned in a binary transformation vector immediately upstream of a suitable reporter gene, or a transactivator gene that is capable of programming expression of a reporter gene in a second gene construct. Reporter genes used include green fluorescent protein (and related fluorescent protein color variants), β-glucuronidase, and luciferase. Suitable transactivator genes include LexA-GAL4, along with a transactivatable reporter in a second binary plasmid (as disclosed in U.S. patent application Ser. No. 09/958,131, incorporated herein by reference). The binary plasmid(s) is transferred into *Agrobacterium* and the structure of the plasmid confirmed by PCR. These strains are introduced into *Arabidopsis* plants as described in other examples, and gene expression patterns determined according to standard methods know to one skilled in the art for monitoring GFP fluorescence, β-glucuronidase activity, or luminescence.

All publications and patent applications mentioned in this specification are herein incorporated by reference to the same extent as if each individual publication or patent application was specifically and individually indicated to be incorporated by reference.

The present invention is not limited by the specific embodiments described herein. The invention now being fully described, it will be apparent to one of ordinary skill in the art that many changes and modifications can be made thereto without departing from the spirit or scope of the appended claims. Modifications that become apparent from the foregoing description and accompanying figures fall within the scope of the claims.

SEQUENCE LISTING (1440 sequences)

SEQ ID NO: 1 - DNA, 785 bp, Arabidopsis thaliana
  G47  reference sequence; clade identifier
cttcttcttcacatcgatcatcatacaacaacaaaaaatggattacagagaatccaccggtgaaagtcagtcaaagtacaaaggaatccgtcgtcggaaatggggcaaatgggtatcagagattagagttccgggaactcgtgaccgtctctggttaggttcattctcaacagcagaaggtgccgccgtagcacacgacgttgctttcttctgtttacaccaacctgattctttagaatctctcaatttccctcatttgcttaatccttcactcgtttccagaacttctccgagatctatccagcaagctgcttctaacgccggcatggccattgacgccggaatcgtccacagtaccagcgtgaactctggatgcggagatacgacgacgtattacgagaatggagctgatcaagtggagccgttgaatatttcagtgtatgattatctgggcggccacgatcacgtttgatttatctcgacggtcatgatcacgtttgatcttcttttgagtaagattttgtaccataatcaaaacaggtgtggtgctaaaatcttactcaaaacaagattaggtaccacagagaaacaatcaaatggttgtgaatatacattataaggttttgattaatgtttgtttcactgatttagtgaagtttggtccattgtatacaaatctattcaagaaacctagcgcgagatcatgtttcgtgattgaagattgagatttttaagtattcgtaatatttttgtaaaatacaaataaaaaaaaaaaaaaaaaaaaa

SEQ ID NO: 2 - protein, 144 aa, Arabidopsis thaliana
  G47 polypeptide reference sequence; clade identifier
MDYRESTGESQSKYKGIRRRKWGKWVSEIRVPGTRDRLWLGSFSTAEGAAVAHDVAFFCLHQPDSLESLNFPHLLNPSLVSRTSPRSIQQAASNAGMAIDAGIVHSTSVNSGCGDTTTYYENGADQVEPLNISVYDYLGGHDHV

SEQ ID NO: 3 - DNA, 1449 bp, Arabidopsis thaliana
  G922 reference sequence; clade identifier
atggtggctatgtttcaagaagataatggaacatcttctgtagcttcatcaccacttcaagtcttctcaactatgtcactcaacagaccgactctcctcgcttcttcatctccgtttcattgtctcaaagatctcaaaccagaggagcgtggtctctacttaatccacctcttgctaacttgtgccaaccacgtggcttcaggtagcctccaaaacgctaacgcagcgctcgagcagctctctcacctcgcttctcctgacggcgacacgatgcagcgaatcgctgcttacttcaccgaagcgcttgctaacagaatccttaagtcctggcctggtctttacaaggctcttaacgcaactcagacaagaactaacaatgtctctgaggagattcatgttagaagactcttctttgagatgttcccgatactcaaagtctcttacttgctcactaatcgagctatactcgaggctatggaaggagagaagatggttcatgtgattgatctcgatgcttctgagccagctcaatggcttgctttgcttcaagcttttaactctaggcctgaaggtccacctcatttgagaatcactggtgttcatcaccagaaggaagtgcttgaacaaatggctcatagactcattgaggaagcagagaaactcgatatcccgtttcagtttaatcccgttgtgagtaggttagactgtttaaatgtagaacagttgcgggttaaaacaggagaggccttagccgttagctcggttcttcaattgcataccttcttggcctctgatgatgatctcatgagaaagaactgcgctttacggtttcagaacaaccctagtggagttgacttgcagagagttctaatgatgagccatggctctgcagctgaggcacgtgagaatgatatgagtaacaacaatgggtatagccctagcggtgactcggcctcatctttgcctttaccaagttcaggaaggactgatagcttcctcaatgctatttggggtttgtctccaaaggtcatggtggtcactgagcaagactcagaccacaacggctccacactaatggagaggctattagaatcactttacacctacgcagcattgtttgattgcttggaaacaaaagttccaagaacgtctcaagataggatcaaagtggagaagatgctcttcggggaggagatcaagaacatcatatcctgcgagggatttgagagaagagaaagacacgagaagcttgagaaatggagccagaggatcgatttggctggttttgggaatgttcctcttagctattatgcgatgttgcaggctaggagattgcttcaagggtgcggttttgatgggtatagaatcaaggaagagagcgggtgcgcagtaatttgctggcaagatcgacctctatactcggtatcagcttggagatgcaggaagtga

SEQ ID NO: 4 - protein, 482 aa, Arabidopsis thaliana
  G922 polypeptide reference sequence; clade identifier
MVAMFQEDNGTSSVASSPLQVFSTMSLNRPTLLASSSPFHCLKDLKPEERGLYLIHLLLTCANHVASGSLQNANAALEQLSHLASPDGDTMQRIAAYFTEALANRILKSWPGLYKALNATQTRTNNVSEEIHVRRLFFEMFPILKVSYLLTNRAILEAMEGEKMVHVIDLDASEPAQWLALLQAFNSRPEGPPHLRITGVHHQKEVLEQMAHRLIEEAEKLDIPFQFNPVVSRLDCLNVEQLRVKTGEALAVSSVLQLHTFLASDDDLMRKNCALRFQNNPSGVDLQRVLMMSHGSAAEARENDMSNNNGYSPSGDSASSLPLPSSGRTDSFLNAIWGLSPKVMVVTEQDSDHNGSTLMERLLESLYTYAALFDCLETKVPRTSQDRIKVEKMLFGEEIKNIISCEGFERRERHEKLEKWSQRIDLAGFGNVPLSYYAMLQARRLLQGCGFDGYRIKEESGCAVICWQDRPLYSVSAWRCRK

SEQ ID NO: 5 - DNA, 585 bp, Arabidopsis thaliana
  G1274  reference sequence; clade identifier
atgaatatctctcaaaaccctagccctaattttacgtacttctccgatgaaaactttattaatccgtttatggataacaacgatttctcaaatttgatgttctttgacatagatgaaggaggtaacaatggattaatcgaggaagagatctcatctccgacaagcatcgtttcgtcggagacatttaccggggaaagcggcggatccggcagcgcaacaacgttgagtaaaaaggaatcaactaatagaggaagtaaagagagtgatcagacgaaggagacgggtcatcgagttgcatttagaacgagatcgaagattgatgtgatggatgatggttttaaatggaggaagtatggcaagaaatctgtcaaaaacaacattaacaagaggaattactacaaatgctcaagtgaaggttgctcggtgaagaagagggtagagagagatggtgacgatgcagcttatgtaattacaacatatgaaggagtccataaccatgagagtctctctaatgtctattacaatgaaatggttttatcttatgatcatgataactggaaccaacactctcttcttcgatcttaa

SEQ ID NO: 6 - protein, 194 aa, Arabidopsis thaliana
  G1274 polypeptide reference sequence; clade identifier
MNISQNPSPNFTYFSDENFINPFMDNNDFSNLMFFDIDEGGNNGLIEEEISSPTSIVSSETFTGESGGSGSATTLSKKESTNRGSKESDQTKETGHRVAFRTRSKIDVMDDGFKWRKYGKKSVKNNINKRNYYKCSSEGCSVKKRVERDGDDAAYVITTYEGVHNHESLSNVYYNEMVLSYDHDNWNQHSLLRS

SEQ ID NO: 7 - DNA, 696 bp, Arabidopsis thaliana
  G1792 reference sequence; clade identifier
aatccatagatctcttattaaataacagtgctgaccaagctcttacaaagcaaaccaatctagaacaccaaagttaatggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttcttgattcagaagaaaggaagagataatcacgattagttttgttttgatattttatgtggcactgttgtggctacctacgtgcattatgtgcatgtataggtcgcttgattagtactttataacatgcatgccacgaccataaattgtaagagaagacgtactttgcgttttcatgaaatatgaatgttagatggtttgagtacaaaaaaaaaaaaaaaaaaaaaaa

SEQ ID NO: 8 - protein, 139 aa, Arabidopsis thaliana
  G1792 polypeptide reference sequence; clade identifier
MESSNRSSNNQSQDDKQARFRGVRRRPWGKFAAEIRDPSRNGARLWLGTFETAEEAARAYDRAAFNLRGHLAILNFPNEYYPRMDDYSLRPPYASSSSSSSSGSTSTNVSRQNQREVFEFEYLDDKVLEELLDSEERKR

SEQ ID NO: 9 - DNA, 1029 bp, Arabidopsis thaliana
  G2053  reference sequence; clade identifier
atggagaatccggtgggtttaagattccgtccgaccgacaaggagatcgtcgtcgattacctccgaccaaaaaactccgatagggacacgagtcatgttgatcgagtcattagcacagtcactatccgtagcttcgacccttgggagttaccttgccagtctaggatcaaactgaaagatgagtcttggtgtttcttcagccctaaggagaacaaatatggcagaggtgatcaacaaattagaaaaacgaaatctggttactggaagattactggcaaaccaaagcctatcttgcgtaaccgccaagagatcggtgagaaaaaggttttgatgttttacatgagtaaggaacttggtggatccaaatccgactgggttatgcacgagtaccatgctttctctcctactcagatgatgatgacatatacaatatgtaaagttatgtttaagggtgacgtgagagagatttcttcttcttctgcttcttatggtagtgaaattgagcagagtcgtgactctttaatccctcttcttgtgaacgattctgaggaagaagctcaaatcgaggatgctataccaatagaggaatgggaaacatggttgactgatgatggtgttgatgagcaggtgaatcatattatgaatatgaaagatgatcgcaacaaccacaggcctcaaaagccattgactggtgtcttgattgacgatagtagtgatgatgatgatgattctgatttgctatctccaacaacaaattctattgaaaattcgagcacttgtgatagttttggtagctcagaccaaatcaacttagtgtcactaactcaagaggtgagccaagctctgataaccagtattgatacacccgagaagattaagagtccttatgatgatgcacaagggactggggctggagggcaaaaattgggtcaagagactcgagagaagaaacgagctggtttctttcacaggatgatacaaatattcgtcaagaaaattcaccaatgttcttctatctcaagaacataa

SEQ ID NO: 10 - protein, 342 aa, Arabidopsis thaliana
  G2053 polypeptide reference sequence; clade identifier
MENPVGLRFRPTDKEIVVDYLRPKNSDRDTSHVDRVISTVTIRSFDPWELPCQSRIKLKDESWCFFSPKENKYGRGDQQIRKTKSGYWKITGKPKPILRNRQEIGEKKVLMFYMSKELGGSKSDWVMHEYHAFSPTQMMMTYTICKVMFKGDVREISSSSASYGSEIEQSRDSLIPLLVNDSEEEAQIEDAIPIEEWETWLTDDGVDEQVNHIMNMKDDRNNHRPQKPLTGVLIDDSSDDDDDSDLLSPTTNSIENSSTCDSFGSSDQINLVSLTQEVSQALITSIDTPEKIKSPYDDAQGTGAGGQKLGQETREKKRAGFFHRMIQIFVKKIHQCSSISRT

SEQ ID NO: 11 - DNA, 485 bp, Arabidopsis thaliana
  G2133 Predicted polypeptide sequence is paralogous to G47
atctcatcttcatccacccaaaaacatggattcaagagacaccggagaaactgaccagagcaagtacaaaggtatccgtcgtcggaaatggggaaaatgggtatcagagattcgtgtcccgggaactcgtcaacgtctctggttaggctctttctccaccgcagaaggcgctgccgtagcccacgacgtcgctttttactgcttgcaccgaccatcttccctcgacgacgaatcttttaacttccctcacttacttacaacctccctcgcctccaatatatctcctaagtccatccaaaaagctgcttccgacgccggcatggccgtggacgccggattccatggtgctgtgtctgggagtggtggttgtgaagagagatcttccatggcgaatatggaggaggaggacaaacttagtatctccgtgtatgattatcttgaagacgatctcgtttgatctatacgagtacgtttttagcagttaa

SEQ ID NO: 12 - protein, 143 aa, Arabidopsis thaliana
  G2133 polypeptide  Paralogous to G47
MDSRDTGETDQSKYKGIRRRKWGKWVSEIRVPGTRQRLWLGSFSTAEGAAVAHDVAFYCLHRPSSLDDESFNFPHLLTTSLASNISPKSIQKAASDAGMAVDAGFHGAVSGSGGCEERSSMANMEEEDKLSISVYDYLEDDLV

SEQ ID NO: 13 - DNA, 891 bp, Arabidopsis thaliana
  G2999 reference sequence; clade identifier
tattagggttttctttattcagaagcttcaagatcagaaaagatggaagttagagagaagaaagatgagaaaatggagatgacaagaagaaaatcatcagctctagatcatcatcgtcttcctccgtacacttactcccaaaccgccaacaaagagaaacccaccaccaaaagaaacgggtcggacccggatccggatccggatcttgatactaacccaatttctatatctcatgctccaagatcatacgctaggcctcaaactacttctccggggaaggcaaggtatagagaatgccaaaagaatcacgcggcgagctccggtggacacgttgtcgacggttgcggcgagtttatgtcttccggggaagaaggcacggtggagtctcttctttgtgcagcttgtgattgccaccggagcttccatagaaaagagatcgatggtttgtttgttgtcaatttcaatagctttggccattcacagagaccactcggaagccgccacgtgtctccgataatgatgagttttggtggtggtggtggttgtgcggcggagtcatcgacggaggatctaaacaagtttcatcaatcttttagtggttatggagtggatcagtttcatcattatcaacccaagaaacggtttaggacaaagtttaatgaagaacagaaggagaagatgatggagtttgctgagaagattggttggagaatgacaaaactagaagatgatgaagtgaatcggttttgtcgtgagattaaagttaaaagacaagtgtttaaagtttggatgcacaacaataaacaagcagcaaagaagaaggatttgtaagagatttctatatatatatatatactatttttacttctctttgttcaacattgctttaac

SEQ ID NO: 14 - protein, 262 aa, Arabidopsis thaliana
  G2999 polypeptide reference sequence; clade identifier
MEVREKKDEKMEMTRRKSSALDHHRLPPYTYSQTANKEKPTTKRNGSDPDPDPDLDTNPISISHAPRSYARPQTTSPGKARYRECQKNHAASSGGHVVDGCGEFMSSGEEGTVESLLCAACDCHRSFHRKEIDGLFVVNFNSFGHSQRPLGSRHVSPIMMSFGGGGGCAAESSTEDLNKFHQSFSGYGVDQFHHYQPKKRFRTKFNEEQKEKMMEFAEKIGWRMTKLEDDEVNRFCREIKVKRQVFKVWMHNNKQAAKKKDL

SEQ ID NO: 15 - DNA, 1621 bp, Arabidopsis thaliana
  G3086 reference sequence; clade identifier
aagtttctctcacgttctcttttttaattttaatttctcgccggaaacaatctcatctcccggcgaacgaaacttccggtgtggtactgcaaacggagaaaaaaataaccaaagaagagagaaactcaaaagctactaagatggaatcagaattccagcaacatcacttccttctccacgatcatcaacaccagagaccaagaaactcaggattgattcgttaccaatcagcaccaagttcgtacttttcgagtttcggtgaatcaatcgaagagtttttagatcgacccacaagtcctgaaactgagcgaatcttatctggctttttacaaaccaccgacacaagcgacaacgttgatagtttccttcaccatacttttaacagtgatggaactgagaagaaacctccggaagttaaaacagaggacgaagatgctgaaattccggtgactgcgacggcgacggcgatggaggttgttgtttccggtgatggtgaaatctcagtgaatcctgaagtatcgattgggtatgtggcttcggtttcgaggaataagagaccaagagagaaagatgatcggactccggtgaataatctagctcgtcataatagttcaccggccggattattttcatccattgatgttgaaacagcttatgcagctgtaatgaaaagtatgggaggttttggaggaagtaatgtgatgagtacaagcaatactgaagcttcgtctcttactcctagaagcaagttacttcctcctacttctagagcgatgagtccgatctctgaggttgatgttaaacccggtttctcgtctagattgcctcctcggacgctttccggtgggtttaatcgttcttttgggaatgaagggtctgcttcttccaagcttacagctcttgctaggacccaatctggaggtctagatcaatacaaaaccaaggatgaggattcagcaagtagacgtcctcctttggcacatcacatgagtttgcccaagtctttatcagatattgaacagttactgtcagattctatcccatgtaagatcagagccaagcggggttgtgcaactcatcctcgaagcatagccgagagggtgagaagaaccaagatcagtgaaagaatgaggaagctgcaagaccttgttccaaacatggacacgcaaacaaacacagcagacatgttggatcttgcggttcaatacatcaaggacctgcaagaacaagtgaaggcgctcgaagagagtcgggcaagatgtagatgctctagtgcgtgaaactagaagtgggagtatgcgcgagtgctagccagggagggagttgtgcatagaagtatcggttcggcctttggagaaaagtcgaagatagcaaagtagagaagagatcatgaacaaagctaaatttggtggtggtggtgaaaagggtttttgtaaagttggaacctttttttggtagggaagaaagtagcaaggttgtgtaatggtccgaactccaatgctattgtatgttcttacatccaaaaaaaagaaaagcagaagagaagtgatgtacaatgagaagcttattttattgtaactcaagaataattcaggtaattagtttaaaaaaaaaaaaaaaa

SEQ ID NO: 16 - protein, 379 aa, Arabidopsis thaliana
  G3086 polypeptide reference sequence; clade identifier
MESEFQQHHFLLHDHQHQRPRNSGLIRYQSAPSSYFSSFGESIEEFLDRPTSPETERILSGFLQTTDTSDNVDSFLHHTFNSDGTEKKPPEVKTEDEDAEIPVTATATAMEVVVSGDGEISVNPEVSIGYVASVSRNKRPREKDDRTPVNNLARHNSSPAGLFSSIDVETAYAAVMKSMGGFGGSNVMSTSNTEASSLTPRSKLLPPTSRAMSPISEVDVKPGFSSRLPPRTLSGGFNRSFGNEGSASSKLTALARTQSGGLDQYKTKDEDSASRRPPLAHHMSLPKSLSDIEQLLSDSIPCKIRAKRGCATHPRSIAERVRRTKISERMRKLQDLVPNMDTQTNTADMLDLAVQYIKDLQEQVKALEESRARCRCSSA

SEQ ID NO: 17 - DNA, 553 bp, Arabidopsis thaliana
  G30 Predicted polypeptide sequence is paralogous to G1792
ctcttctgacgcacaacagtatatacacatacacagatatatggatcaaggaggtcgtagcagtggtagtggaggaggaggagccgagcaagggaagtaccgtggagtaaggagacgaccttggggtaaatacgccgcggaaataagagattcgaggaagcacggagagcgtgtgtggctagggacattcgacactgcggaagacgcggctcgagcctatgaccgagccgcctattcaatgagaggcaaagctgccattctcaacttccctcacgagtataacatgggaaccggatcctcatccactgcggctaattcttcttcctcgtcgcagcaagtttttgagtttgagtacttggacgatagcgttttggatgaacttcttgaatatggagagaactataacaagactcataatatcaacatgggcaagaggcaataaagggaatacaatcggtattaactgaaagttatgtgaaagaccattttcagttataacaaataaaataaaatcccaagcgtacaaagctgtttctaaaaaaaaaaaaaaaaa

SEQ ID NO: 18 - protein, 133 aa, Arabidopsis thaliana
  G30 polypeptide  Paralogous to G1792
MDQGGRSSGSGGGGAEQGKYRGVRRRPWGKYAAEIRDSRKHGERVWLGTFDTAEDAARAYDRAAYSMRGKAAILNFPHEYNMGTGSSSTAANSSSSSQQVFEFEYLDDSVLDELLEYGENYNKTHNINMGKRQ

SEQ ID NO: 19 - DNA, 1462 bp, Arabidopsis thaliana
  G515 Predicted polypeptide sequence is paralogous to G2053
caaccatggcgaaagctctccaatgcatatttttttgatcttttccttttcccttcttttttgatcgctgcagagaaatggaaactcctgtgggtttaagattctgtccgaccgacgaggagatcgtcgtcgattacctttggccgaaaaattccgatagagacacgagccatgtcgatcgattcattaacacagtccctgtctgtagactcgatccttgggagttaccttgccagtcaaggatcaaactgaaagatgtggcttggtgtttcttcagacctaaggagaacaaatatggcagaggtgatcagcagatgagaaaaacgaaatctgggttttggaagagtactggcagaccaaagcctatcatgcgtaatcgccaacagatcggtgagaaaaagattttgatgttttacacgagtaaggaatccaaatccgattgggttatacacgagtaccacggtttctctcataaccagatgatgatgacatacacactctgtaaagttatgtttaatggtggcatgagagagaagtcttcctcttctccttcttcttctggtgttagtggaattgagcagagtcgtcgtgactctttaatccctcagcttgtcaacaattctgagggatcctcacttcacagagaagatccaagtcagtttggtgatgtgctgcaagaagctccaatcgaggatgctaaactgaccgaggaattggtaaaatggctgatgaatgatgaggatgatgctcaaatcgaggatgctataccgattgaggaatgggaaacatggttgaatgatattgatgatgctaaggagaagagtatcatgtttatgcatgataatcgaagtgattacagacctccaaactcattaactggtgtcttcagtgatgatgttagcagtgatgataatgattctgatttgctaactccaaaaacaaactctattcaaacttcgagcacttgtgatagttttggtagctcaaatcatcgcatagaccagatcaaagacctgcaagaatctcctacctcaacaatcaacttagtgtcactaactcaagaggtgagccaagctctaataaccagtattgataccgccgagaagaagaagaatccttatgatgatgcacaagggactgagattggtgagcataaattgggtcaagagacgatcaagaagaaaagagctggtttctttcacaggatgatacaaaaattcgtcaagaaaattcacctatgttcttccatctcaagaacttgataacaataaaagtgatcaataacaccttttctactttccaaattatttacaacagtacaagtgtatgctatgatgtctatcttggtttgtaactttaccatactgtatgtgtgatatgtataaaactggtaaatttgtgaagacaaatttgtatccattgacataataatgtctatcttgttttgttaaaaaaaaaaaaa

SEQ ID NO: 20 - protein, 394 aa, Arabidopsis thaliana
  G515 polypeptide  Paralogous to G2053
METPVGLRFCPTDEEIVVDYLWPKNSDRDTSHVDRFINTVPVCRLDPWELPCQSRIKLKDVAWCFFRPKENKYGRGDQQMRKTKSGFWKSTGRPKPIMRNRQQIGEKKILMFYTSKESKSDWVIHEYHGFSHNQMMMTYTLCKVMFNGGMREKSSSSPSSSGVSGIEQSRRDSLIPQLVNNSEGSSLHREDPSQFGDVLQEAPIEDAKLTEELVKWLMNDEDDAQIEDAIPIEEWETWLNDIDDAKEKSIMFMHDNRSDYRPPNSLTGVFSDDVSSDDNDSDLLTPKTNSIQTSSTCDSFGSSNHRIDQIKDLQESPTSTINLVSLTQEVSQALITSIDTAEKKKNPYDDAQGTEIGEHKLGQETIKKKRAGFFHRMIQKFVKKIHLCSSISRT

SEQ ID NO: 21 - DNA, 1053 bp, Arabidopsis thaliana
  G516 Predicted polypeptide sequence is paralogous to G2053
atggcgaatccggtgggttttagattccgtccgactgacggggagatcgtcgacatttacctccgaccgaaaaatctcgaaagtaacacgagccatgtcgatgaagtcattagcacagttgatatttgtagcttcgacccttgggacttaccttcccattctaggatgaaaacaagagatcaggtttggtatttcttcggccgtaaggagaacaaatatggtaaaggtgatcgacagataagaaaaaccaagtctggtttttggaagaaaactggcgttaccatggatataatgcgcaaaacgggagatcgtgagaagatcggtgagaaaagggttttggtgtttaagaatcacggtggttccaagtccgattgggctatgcatgagtatcacgctacgttctcgtctcctaatcagggtgaaaggagagaattttcagttgctactggtagtggaattaagcatactcactctttaatccctcctaccaacaattctggagttttgagtgtagagacagagggatcgttgtttcacagccaagaatcacagaatccaagtcagttttctggctttcttgatgtggatgcactagatagggacttctgcaatattttgagtgatgatttcaaaggcttctttaatgatgacgatgagcagagtaagattgtttctatgcaagatgatcgcaacaaccacacacctcaaaagccattgaccggtgtcttcagtgatcatagcaccgatggtagtgattctgatccgatttctgcaacaactatttccattcaaactttaagcacttgtcctagttttggtagctcaaatcctctataccaaatcactgacttgcaggaatctcctaactcaatcaagttagtgtcattagctcaagaggtgagcaaaacaccgggaaccggtattgataatgatgcacaagggactgagattggtgagcataaattgggtcaagagacgatcaagaacaaaagagctggtttctttcacaggatgatacaaaaattcgtcaagaaaattcacctaagaacatga

SEQ ID NO: 22 - protein, 350 aa, Arabidopsis thaliana
  G516 polypeptide  Paralogous to G2053
MANPVGFRFRPTDGEIVDIYLRPKNLESNTSHVDEVISTVDICSFDPWDLPSHSRMKTRDQVWYFFGRKENKYGKGDRQIRKTKSGFWKKTGVTMDIMRKTGDREKIGEKRVLVFKNHGGSKSDWAMHEYHATFSSPNQGERREFSVATGSGIKHTHSLIPPTNNSGVLSVETEGSLFHSQESQNPSQFSGFLDVDALDRDFCNILSDDFKGFFNDDDEQSKIVSMQDDRNNHTPQKPLTGVFSDHSTDGSDSDPISATTISIQTLSTCPSFGSSNPLYQITDLQESPNSIKLVSLAQEVSKTPGTGIDNDAQGTEIGEHKLGQETIKNKRAGFFHRMIQKFVKKIHLRT

SEQ ID NO: 23 - DNA, 1080 bp, Arabidopsis thaliana
  G517 Predicted polypeptide sequence is paralogous to G2053
atgatgaatccggtgggtttcagattccgtccaaacgacgaggagatcgtcgaccattacctccggccaaaaaatctcgatagtgacactagccatgtcgatgaagtcattagcacagtcgatatctgtagcttcgagccttgggatttaccttccaagtcgatgatcaaatcgagagatggggtttggtatttctttagtgttaaggagatgaagtataacagaggtgatcaacagagaagaagaacaaactctgggttttggaagaaaactggaaaaacaatgactgtcatgcgcaaaagaggaaatcgtgagaagatcggtgagaaaagggttttggtttttaagaatcgagatggttcaaagaccgactgggttatgcacgagtatcacgctacgtccttgtttcctaatcagatgatgacgtatacagtctgcaaagttgagtttaagggtgaagagacagagatctcttcttcttctactggtagtgaaattgaacagattcactctttaatccctcttgtgaacagttctggaggatctgagggttcgtcgtttcacagccaagaattacagaattcaagtcagtctggtgtctttgctaatgtgcagggagaatctcaaatcgatgatgcaactacaccgattgaggaggaatggaaaacatggttgaataatgatggtgatgagcagaggaatatcatgtttatgcaagatcatcgcagcgattacacacctctaaagtcgttaactggtgtcttcagtgatgatagcagtgatgataatgattctgatttgatatctcctaaaacaaattctattggaacttcgagcacttgtgctagttttgctagctcaaatcatcagatagaccaaactcaacattctcctgactcaacagtccagctagtgtcattaactcaagaggtgagccaaggtccgggtcaagtgactgtgattcgagagcataaattgggtgaagagtctgtcaagaagaaaagagctagtttcgtttacaggatgatacacagattagtcaagaaaattcaccaatgttattctatctcaagaacatga

SEQ ID NO: 24 - protein, 359 aa, Arabidopsis thaliana
  G517 polypeptide Paralogous to G2053
MMNPVGFRFRPNDEEIVDHYLRPKNLDSDTSHVDEVISTVDICSFEPWDLPSKSMIKSRDGVWYFFSVKEMKYNRGDQQRRRTNSGFWKKTGKTMTVMRKRGNREKIGEKRVLVFKNRDGSKTDWVMHEYHATSLFPNQMMTYTVCKVEFKGEETEISSSSTGSEIEQIHSLIPLVNSSGGSEGSSFHSQELQNSSQSGVFANVQGESQIDDATTPIEEEWKTWLNNDGDEQRNIMFMQDHRSDYTPLKSLTGVFSDDSSDDNDSDLISPKTNSIGTSSTCASFASSNHQIDQTQHSPDSTVQLVSLTQEVSQGPGQVTVIREHKLGEESVKKKRASFVYRMIHRLVKKIHQCYSISRT

SEQ ID NO: 25 - DNA, 1413 bp, Arabidopsis thaliana
  G592 Predicted polypeptide sequence is paralogous to G3086
aagctattaagatttggttttctacaaatttgttcttcctgaaacgtcacgagacagagcttacaagaagagaaaacagaggaaatttcgttgcattttttttacatattgattcgattaatggattcaaataatcatctctacgacccgaatcccaccgggtcgggtcttcttcgttttagatcagctccgagctctgttctcgccgcttttgttgacgacgacaagattggtttcgactccgataggttgctttcaagattcgtgacctctaatggcgttaacggagatctgggttcacctaaattcgaggataagtctccggtttcgttaacgaacacctctgtttcatacgccgccactctgccgccaccgccgcagcttgagccgtcgagttttctgggtttgccgccgcattacccgaggcagagtaaagggataatgaactcggttggtttggatcagtttctcggtatcaataatcatcacaccaaaccagttgaatctaatcttctccgtcaaagcagctctccagccggaatgtttactaatctctctgaccaaaacggttatggttcaatgaggaatttgatgaattacgaagaagatgaagagagtccatctaattccaatggattaagacgccattgcagtctctcttcaaggccaccttcttcacttggaatgctttctcaaatacctgaaatcgcacccgaaactaattttccatatagccattggaatgatccatccagctttattgataacttatcctcacttaaaagagaagccgaggacgatggaaaattgtttctcggagctcagaacggagagtccgggaatcgtatgcagttactgtcgcatcatttgagcctaccaaagtcatcatcgacagcctcggacatggtttcagtggataagtatcttcagctacaagattctgttccttgtaaaatcagagccaaacgtggttgcgctacacatcctcgaagcatcgctgaacgggtaagaagaacgcggataagcgagcgaatgaggaagttacaagagcttgttcctaacatggacaagcaaaccaacacttcggatatgttggatttagctgtggattacatcaaagatttacaaagacagtataagattttaaacgacaacagagctaactgtaagtgtatgaacaaggagaagaagtcaatatagggcgcaacaaagtgtgtagtagataggactaaaaagcagggagaaggacaagaaagaaacaatgtcatgtctgaatattttttagccgaaacagaccaaattgtctatgtaagctctcgagaaaagcatctgcttccaacaaaattctaagtaataaaatagtactcgatttgttcttatttcattattacaatgcagaatctactaatcaaa

SEQ ID NO: 26 - protein, 359 aa, Arabidopsis thaliana
  G592 polypeptide  Paralogous to G3086
MDSNNHLYDPNPTGSGLLRFRSAPSSVLAAFVDDDKIGFDSDRLLSRFVTSNGVNGDLGSPKFEDKSPVSLTNTSVSYAATLPPPPQLEPSSFLGLPPHYPRQSKGIMNSVGLDQFLGINNHHTKPVESNLLRQSSSPAGMFTNLSDQNGYGSMRNLMNYEEDEESPSNSNGLRRHCSLSSRPPSSLGMLSQIPEIAPETNFPYSHWNDPSSFIDNLSSLKREAEDDGKLFLGAQNGESGNRMQLLSHHLSLPKSSSTASDMVSVDKYLQLQDSVPCKIRAKRGCATHPRSIAERVRRTRISERMRKLQELVPNMDKQTNTSDMLDLAVDYIKDLQRQYKILNDNRANCKCMNKEKKSI

SEQ ID NO: 27 - DNA, 1064 bp, Arabidopsis thaliana
  G1134 Predicted polypeptide sequence is paralogous to G3086
taaagaaagagaaaaaaagctttcgtagtgtctattgaaaccagagaaaagccaaaggggatgcaaccaacatccgtcggtagtagcggcggtggtgacgacggaggaggcagaggaggaggaggagggctaagtagaagtggactatctcggatccgttcagctccagcgacttggcttgaagctttacttgaggaagatgaagaagagtctttgaaacctaatcttggtctcaccgatttgcttaccgggaactcgaacgatttaccgacaagtcgcggctcgttcgagttcccgattcctgttgagcaagggttgtatcaacaaggtgggtttcaccgacagaatagtactccggcggattttcttagtggttctgatggatttatccaaagctttgggattcaggcgaattacgattacttatcggggaatatcgatgtttctccgggaagtaagcggtctagagaaatggaagcactcttctcttctcctgagtttacttctcaaatgaaaggagagcaaagcagcggtcaagttcctaccggagtatcaagcatgtcggatatgaacatggagaaccttatggaggactctgttgcttttagggttcgggctaaacgtggttgcgcaactcatccccgcagcattgccgagagggtacgaaggacgcggattagtgatcggataaggaagctacaagagcttgtacctaacatggacaagcaaaccaacactgcagacatgttagaagaagcagtagaatacgtgaaagttcttcaaaggcagatccaggagttaacagaagaacagaagaggtgcacatgcatacctaaggaagaacaataaggtttgctcctgatttgttttatatttgcttaacggcaatgatctgatcgaaaaattcgaaagatgatcttagcttgaatttagatggatgtcatgttgaaaagtatattatttgataaatggatgtaggtgtaatataaaatttttgtacaataatgaagaaagttaaaaagaattaatgaaaacatatattctttatgatataaaaaaaaaaa

SEQ ID NO: 28 - protein, 262 aa, Arabidopsis thaliana
  G1134 polypeptide Paralogous to G3086
MQPTSVGSSGGGDDGGGRGGGGGLSRSGLSRIRSAPATWLEALLEEDEEESLKPNLGLTDLLTGNSNDLPTSRGSFEFPIPVEQGLYQQGGFHRQNSTPADFLSGSDGFIQSFGIQANYDYLSGNIDVSPGSKRSREMEALFSSPEFTSQMKGEQSSGQVPTGVSSMSDMNMENLMEDSVAFRVRAKRGCATHPRSIAERVRRTRISDRIRKLQELVPNMDKQTNTADMLEEAVEYVKVLQRQIQELTEEQKRCTCIPKEEQ

SEQ ID NO: 29 - DNA, 748 bp, Arabidopsis thaliana
  G1275  Predicted polypeptide sequence is paralogous to G1274
ccaagaaaagggaagatcacgcattcttataggcgtaattcgtaaatagtggtgagtatgaatgatgcagacacaaacttggggagtagtttcagcgatgatactcactctgtgttcgagtttccggagctagacttgtcagatgaatggatggatgatgatcttgtgtctgcggtttccgggatgaatcagtcttatggttatcagactagtgatgttgctggtgctttattctcaggttcttctagctgtttcagtcatcctgaatctccaagtaccaaaacttatgttgctgctacagccactgcttctgccgacaaccaaaacaagaaagaaaagaaaaaaattaaagggagagttgcgttcaagacacggtccgaggtggaagtgcttgacgacgggttcaagtggagaaagtatgggaagaagatggtgaagaacagcccacatccaagaaactactacaaatgttcagttgatggctgtcccgtgaagaaaagggttgaacgagacagagatgatccgagctttgtgataacaacttacgagggttcccacaatcactcaagcatgaactaagactcgaactaaggctcaaggcgaccatgctatattcagcacatcttattttctatggttacgaacgatacttaaaactgcttctagttctttatatccattgtaaactggttgcaggttcacaaattttgagaggtttatgacattctaaatctgtagtacttatata

SEQ ID NO: 30 - protein, 173 aa, Arabidopsis thaliana
  G1275 polypeptide  Paralogous to G1274
MNDADTNLGSSFSDDTHSVFEFPELDLSDEWMDDDLVSAVSGMNQSYGYQTSDVAGALFSGSSSCFSHPESPSTKTYVAATATASADNQNKKEKKKIKGRVAFKTRSEVEVLDDGFKWRKYGKKMVKNSPHPRNYYKCSVDGCPVKKRVERDRDDPSFVITTYEGSHNHSSMN

SEQ ID NO: 31 - DNA, 896 bp, Arabidopsis thaliana
  G1758 Predicted polypeptide sequence is paralogous to G1274
gtccctcctcttagcttcaaccgccggaaaaactaaacaaccttcttggaaaaaaagagaaactaaaaatgaactatccttcaaaccctaaccctagctccacagatttcactgaatttttcaagttcgatgattttgacgatacttttgagaagatcatggaagaaatcggccgtgaggaccactcgtcgtcaccgactttgagttggagttcatcggaaaagttagtggctgcagaaatcacaagcccgcttcaaacaagcctagctacctcacctatgagctttgaaataggtgacaaagatgaaatcaaaaagaggaagagacacaaagaagatccgattattcacgtcttcaaaacgaaatcatcaattgatgaaaaggttgctttagatgatgggtataaatggaggaaatacggaaagaagccgataacgggtagtccatttccaaggcattatcacaagtgttcgagcccagattgcaacgtgaagaagaagatcgaaagagatacgaacaatccagattacatattgacaacatacgaaggtagacataaccacccaagcccttctgtagtttattgtgattcagacgactttgatcttaactctctcaacaattggtcctttcagacggcaaatacgtatagtttctctcattctgctccatattgatcgatcgtagttacaagtttgtgtatatagatgtatatatatatatcaccaattcaccatcgtaatcacgtctcacatgtaactacgtacatatatcttgttcggggttcgttttgtaatgtattgaattggtggaggtagaatggaagtcatcttgtatagttgtacttgtatgtaaggtttgatagtcattttttataaagtaactaatttgtacaa

SEQ ID NO: 32 - protein, 202 aa, Arabidopsis thaliana
  G1758 polypeptide  Paralogous to G1274
MNYPSNPNPSSTDFTEFFKFDDFDDTFEKIMEEIGREDHSSSPTLSWSSSEKLVAAEITSPLQTSLATSPMSFEIGDKDEIKKRKRHKEDPIIHVFKTKSSIDEKVALDDGYKWRKYGKKPITGSPFPRHYHKCSSPDCNVKKKIERDTNNPDYILTTYEGRHNHPSPSVVYCDSDDFDLNSLNNWSFQTANTYSFSHSAPY

SEQ ID NO: 33 - DNA, 549 bp, Arabidopsis thaliana
  G1791 Predicted polypeptide sequence is paralogous to G1792
atgtacatgcaaaaacaaaaaccttaaaagctttcatggaacgtatagagtcttataacacgaatgagatgaaatacagaggcgtacgaaagcgtccatggggaaaatatgcggcggagattcgcgactcagctagacacggtgctcgtgtttggcttgggacgtttaacacagcggaagacgcggctcgggcttatgatagagcagctttcggcatgagaggccaaagggccattctcaattttcctcacgagtatcaaatgatgaaggacggtccaaatggcagccacgagaatgcagtggcttcctcgtcgtcgggatatagaggaggaggtggtggtgatgatgggagggaagttattgagttcgagtatttggatgatagtttattggaggagcttttagattatggtgagagatctaaccaagacaattgtaacgacgcaaaccgctagatcatcactacttacttacagtgtaatgtttttggagtaaagagtaataatcaatataatatactttagtttaggaaaaaaaaaaaaaaaaaaa

SEQ ID NO: 34 - protein, 139 aa, Arabidopsis thaliana
  G1791 polypeptide  Paralogous to G1792
MERIESYNTNEMKYRGVRKRPWGKYAAEIRDSARHGARVWLGTFNTAEDAARAYDRAAFGMRGQRAILNFPHEYQMMKDGPNGSHENAVASSSSGYRGGGGGDDGREVIEFEYLDDSLLEELLDYGERSNQDNCNDANR

SEQ ID NO: 35 - DNA, 450 bp, Arabidopsis thaliana
  G1795 Predicted polypeptide sequence is paralogous to G1792
acaaacacgcaaaaagtcattaatatatggatcaaggaggtcgaggtgtcggtgccgagcatggaaagtaccggggagttcggagacgaccttggggaaaatatgcagcagagatacgagattcgaggaagcacggtgaacgtgtgtggcttggaacgttcgatacggcagaggaagcggctagagcctatgaccaagctgcttactccatgagaggccaagcagcaatccttaacttccctcatgagtataacatggggagtggtgtctcttcttccaccgccatggctggatcttcctccgcctccgcctccgcttcttcttcttctaggcaagtttttgaatttgagtacttggatgatagtgttttggaggagctccttgaggaaggagagaaacctaacaagggcaagaagaaatgagcgagatataattcatgattatttctaa

SEQ ID NO: 36 - protein, 131 aa, Arabidopsis thaliana
  G1795 polypeptide  Paralogous to G1792
MDQGGRGVGAEHGKYRGVRRRPWGKYAAEIRDSRKHGERVWLGTFDTAEEAARAYDQAAYSMRGQAAILNFPHEYNMGSGVSSSTAMAGSSSASASASSSSRQVFEFEYLDDSVLEELLEEGEKPNKGKKK

SEQ ID NO: 37 - DNA, 1353 bp, Arabidopsis thaliana
  G2149 Predicted polypeptide sequence is paralogous to G3086
aatcttttatttttcttttagaaaccaaacttttcagatttctctctctccatttggcgatagaagaagtcatgtaccaatcatcatcctccacgtcatcatcatcgcagagatcatcgcttcccggcggcggaggactgatccgttacggctcagctccgggatcgtttctaaactctgtggttgacgaagtcatcggaggaggctcatcaaacgctcgtgacttcaccggctatcaaccgtcgtcggataacttcatcggtaactttttcaccggagctgctgactcatcctcgctgagatccgattcgacgacttgtggagtcaacaactcatccgacggacagaaacagctaggcaataacaataataataatagtaataaagatatcttcctcgacagatcctacggtggattcaacgagatctcgcaacaacacaagagcaacgacatcggaggaggaaacagctcaggatcttactctctcgctagacaacgtagctctcccgccgatttcttcacctacctcgcctcagataaaaacaatttctcgttgaaccaaccaaccagtgattatagtccgcaaggagggtctaatgggggacgaggacattccagattgaagtctcagctaagcttcacgaatcacgactctctggctcggatcaacgaggtcaatgagaccccagtccacgacggttcaggccattcgttttctgcggctagctttggtgcagccactactgattcttgggatgacggttccggttcgatagggtttaccgtgactaggcccagtaaacgatccaaggacatggactctggtctcttttcgcagtatagtcttccttcagacacttcaatgaactacatggataacttcatgcagcttccagaagattctgtaccctgcaaaatccgggccaaacgcggctgcgccacccatcctagaagcatcgctgagcgggagaggagaacgagaataagtgggaagctaaagaagctacaagatcttgtccccaacatggataagcaaacaagctattcagacatgctggatttagctgtacaacacatcaaaggccttcagcatcaacttcagaatttgaaaaaagatcaagagaattgcacgtgtgggtgcagtgagaaaccaagctagctcaaacccaaaggtagggtcatcctaattttatttgcattgttccgattttatcatatgagagaattagagaagatgtaaataaaatagattatattaaatgtctaatcctcttataattaagctcctcattcgttatcattataagatagaacagtgacaattgtccattatgtttttgtttcaagtttat

SEQ ID NO: 38 - protein, 362 aa, Arabidopsis thaliana
  G2149 polypeptide  Paralogous to G3086
MYQSSSSTSSSSQRSSLPGGGGLIRYGSAPGSFLNSVVDEVIGGGSSNARDFTGYQPSSDNFIGNFFTGAADSSSLRSDSTTCGVNNSSDGQKQLGNNNNNNSNKDIFLDRSYGGFNEISQQHKSNDIGGGNSSGSYSLARQRSSPADFFTYLASDKNNFSLNQPTSDYSPQGGSNGGRGHSRLKSQLSFTNHDSLARINEVNETPVHDGSGHSFSAASFGAATTDSWDDGSGSIGFTVTRPSKRSKDMDSGLFSQYSLPSDTSMNYMDNFMQLPEDSVPCKIRAKRGCATHPRSIAERERRTRISGKLKKLQDLVPNMDKQTSYSDMLDLAVQHIKGLQHQLQNLKKDQENCTCGCSEKPS

SEQ ID NO: 39 - DNA, 1167 bp, Arabidopsis thaliana
  G2555 Predicted polypeptide sequence is paralogous to G3086
ctgtttttgtatccgtgtaaattaatcacacggtagtttttgatgaaaagacaacaatcggagaacaatctggtctgctgctaaaatttaataaattgttttgtctaattgtctccacccataaaaaagcgcgaattcaattcaccgactaaagacattctccggtggagaccccgatgcaatccactcatataagcggcggaagtagcggtggtggtggtggaggaggaggagaggtgagtcgaagtggattatctcggatccgttcagctccagctacttggattgaaaccctactcgaagaagatgaagaagaaggtttaaaacctaacctttgtttaacagagctgcttactggtaataataactctggaggagtgataacgagtcgtgacgactcgttcgagttcctgagttctgttgagcaaggattgtataatcatcatcaaggtggtggctttcaccgtcagaatagttctccggctgattttcttagtgggtctggttctgggactgatgggtatttctctaattttggtattccggcgaattatgactatttgtcgaccaacgttgatatttctccgactaaacggtctagagatatggaaacacagttttcttctcagctgaaagaagagcaaatgagtggtgggatatcaggaatgatggatatgaacatggacaagatttttgaggattcagttccttgtagggttcgtgctaaacgtggttgtgctactcatcctcgtagcattgctgaacgggtgagaagaacgcgaataagtgatcggattaggaggctgcaagagcttgttcctaacatggataagcaaaccaacactgcagacatgttggaagaagctgtggagtatgtgaaggctcttcaaagccagatccaggaattgacagagcagcagaagagatgcaaatgcaaacctaaagaagaacaataatgtatcctttaggatttgatatatctgtattttatttttgtactatctaaaaatggtgatgatctgttcgaaaattcgaaacatgatcttatatattgaactagaaaaaatagatatatatgaattttagctgtaaaatttttgtacaataaggagaaaaagatttagaagagtcaataaaaagatgatgtttacaagtcaaaaaaaaaaa

SEQ ID NO: 40 - protein, 259 aa, Arabidopsis thaliana
  G2555 polypeptide  Paralogous to G3086
MQSTHISGGSSGGGGGGGGEVSRSGLSRIRSAPATWIETLLEEDEEEGLKPNLCLTELLTGNNNSGGVITSRDDSFEFLSSVEQGLYNHHQGGGFHRQNSSPADFLSGSGSGTDGYFSNFGIPANYDYLSTNVDISPTKRSRDMETQFSSQLKEEQMSGGISGMMDMNMDKIFEDSVPCRVRAKRGCATHPRSIAERVRRTRISDRIRRLQELVPNMDKQTNTADMLEEAVEYVKALQSQIQELTEQQKRCKCKPKEEQ

SEQ ID NO: 41 - DNA, 1304 bp, Arabidopsis thaliana
  G2766 Predicted polypeptide sequence is paralogous to G3086
ctttctctcaaaccctctcctcaagattttttcctaagcatcagattagcttttgtagggtttttcttttccggtttcatgtaccctcctaattcctctaagtccaccgctcatgacggcggcggcgatgccgacaccaatcaatatgactcagccgctggagctacccgtgatttctcctctcttggccctcaaacccaccatcatccgccaccgcagcggcagcagcagcatcagcagaatcccaacctcgtcggccattatttaccgggcgagccatcttccatcggattcgattccaacgcttcttcttcgtcttctttgttccgacacagaagctctccggctggattctacgaccaacatcttcccactgatcccaacggtttttctctaggacggccaaacggaggctacggcggaggaggagagcaagggccgtcgaggttgaagtcggagctgagattctctagtgggagtagtagccatcaagaacataattctctaccgcgaatctcggaggttgaagcggctgcagcggctagaaacggtgtcgcatcaagtagtatgagttttggaaataatcgtactaacaattgggacaactcgtcttctcatatcagtttcaccattgatcaacccggaaaacggtccaagaactccgactttttcaccttagaaactcagtatagcatgccgcaaacaactctggaaatggcgacaatggagaacttgatgaacatcccagaggactcggtgccttgtagggctagagccaagcgcggcttcgcgactcacccacgcagcattgctgaaagggagagaagaacgaggataagcgggaagctgaagaagctacaagaacttgtgcctaatatggacaagcaaacgagctacgcagatatgttggatttggctgttgagcatatcaaaggtcttcagcaccaagtagagtcactggaaaagggaatggagagatgtacttgtggggcatgcaagaagcgatgatgaatgatattgttccaagtatgatgcaataaagtatagaagaaaaggagatcacttacgaaccaaattctaagacagaaagaaacatagcaaaaaggagttattttggaggtctaaagaaagtgatgatggattaatgaaggctggttttgttactctctgaaagtcttgacctttattataacttaaaattcgatcaatcgattttttttttcctgttttcctcaaagttggttaattttagcttagagcaaaacccattatttgagattgaaagagatgcgcgtttgtgtgtg

SEQ ID NO: 42 - protein, 309 aa, Arabidopsis thaliana
  G2766 polypeptide  Paralogous to G3086
MYPPNSSKSTAHDGGGDADTNQYDSAAGATRDFSSLGPQTHHHPPPQRQQQHQQNPNLVGHYLPGEPSSIGFDSNASSSSSLFRHRSSPAGFYDQHLPTDPNGFSLGRPNGGYGGGGEQGPSRLKSELRFSSGSSSHQEHNSLPRISEVEAAAAARNGVASSSMSFGNNRTNNWDNSSSHISFTIDQPGKRSKNSDFFTLETQYSMPQTTLEMATMENLMNIPEDSVPCRARAKRGFATHPRSIAERERRTRISGKLKKLQELVPNMDKQTSYADMLDLAVEHIKGLQHQVESLEKGMERCTCGACKKR

SEQ ID NO: 43 - DNA, 1011 bp, Arabidopsis thaliana
  G2989  Predicted polypeptide sequence is paralogous to G2999
taagcttaacataaaccctaatattttcttgatttttttcaagaaaataaaaacataaagatgcttgaagttagatcaatggatatgactccaaaatcaccagaacccgaatccgaaactccgacccggatccaaccagctaaaccaatctctttcagtaacggaatcatcaaacgccaccaccaccaccaccacaacaacaacaaagtcacttacaaagaatgtctcaagaaccacgcggcggcgattggtggtcacgcgcttgacggttgcggcgaatttatgccgtctccttcgtcaacaccttccgatccaacttctctcaagtgtgcagcttgtggttgtcaccgtaacttccaccgccgtgaaactgacgattcctccgccgttccaccaccgtctcttcttccatcttcaacaacaaccgccgcaattgagtatcagcctcatcaccgtcatcatcctcctcctccgctagctcctccgttaccacgtagtcctaattcatcttctccgccgcctatctcttcctcctacatgcttttagctctctccggtaataataaaaccgcaccgttctcagatctaaacttcgccgccgcggctaaccatctctccgccacgcctggctcgaggaagcgattcaggacgaagtttagctcaaatcagaaagagaagatgcatgaattcgccgatcgaatcggttggaagattcagaaacgtgacgaagacgaagttcgtgatttttgccgtgagatcggagttgataaaggtgttctcaaagtttggatgcataataacaaaaactccttcaaattctccggcggaggagcaaccaccgtgcagagaaacgataacggtatcggcggcgagaacagtaacgatgatggagttcgcggtttagctaacgacggtgacggtggtggtgggagatttgagagtgatagtggaggagctgatggtggcggaaacgtaaacgcctcgtcgtcttcgtcgtgaagaagaaaacat

SEQ ID NO: 44 - protein, 312 aa, Arabidopsis thaliana
  G2989 polypeptide  Paralogous to G2999
MLEVRSMDMTPKSPEPESETPTRIQPAKPISFSNGIIKRHHHHHHNNNKVTYKECLKNHAAAIGGHALDGCGEFMPSPSSTPSDPTSLKCAACGCHRNFHRRETDDSSAVPPPSLLPSSTTTAAIEYQPHHRHHPPPPLAPPLPRSPNSSSPPPISSSYMLLALSGNNKTAPFSDLNFAAAANHLSATPGSRKRFRTKFSSNQKEKMHEFADRIGWKIQKRDEDEVRDFCREIGVDKGVLKVWMHNNKNSFKFSGGGATTVQRNDNGIGGENSNDDGVRGLANDGDGGGGRFESDSGGADGGGNVNASSSSS

SEQ ID NO: 45 - DNA, 1107 bp, Arabidopsis thaliana
  G2990  Predicted polypeptide sequence is paralogous to G2999
agtcttttttttcttcaaattattggttatattaatgttttaagctatgatggatatgactcctacaataacaacaacaacaacaccaactcctaaatcacccgaacccgaatccgaaactccgacccggatccaaccggcgaaacccatttcctttagcaacggcatcatcaaacgccaccaccaccaccaccatcctctcctctttacttacaaagaatgtctcaaaaaccacgcggcggctttaggtggtcacgctctcgacggttgcggcgaattcatgccgtctccgtcgtcaatctcctccgatccaacttctctcaaatgtgctgcttgtggctgccaccgtaatttccaccgccgtgatccagataacaacaacgactcttcccaaatccctcctcctccttccaccgccgtagagtatcaacctcaccaccgtcatcatccaccaccaccaccacctcctccaccaccacgtagtcctaactcagcttctcctccaccaatctcttcctcttacatgctcttatctctctccggtactaataacaacaacaacaacttagcttctttctccgatcttaacttctccgccggaaacaaccaccaccaccaccaccaacatactcttcacggatctcgtaaaagattccgaacaaaattcagccagtttcagaaagagaagatgcatgaattcgccgaacgtgttggttggaagatgcaaaaacgtgacgaagacgatgttcgtgatttttgccggcagatcggagttgataaaagtgttctcaaagtttggatgcataacaacaaaaacacctttaaccgccgtgatatcgccggaaacgagatccggcaaatcgataacggcggaggaaaccacactccgattctcgccggcgagattaataaccataacaatggacaccacggtgtcggaggaggaggagagcttcaccagagtgttagtagcggcggtggtggcggaggatttgatagtgatagcggcggagctaacggtggtaacgttaacggatcatcgtcgtcgtgaagttaaagatgagagtgtcaggttaataagaagcttagagtaagcttattcggata

SEQ ID NO: 46 - protein, 334 aa, Arabidopsis thaliana
  G2990 polypeptide  Paralogous to G2999
MMDMTPTITTTTTPTPKSPEPESETPTRIQPAKPISFSNGIIKRHHHHHHPLLFTYKECLKNHAAALGGHALDGCGEFMPSPSSISSDPTSLKCAACGCHRNFHRRDPDNNNDSSQIPPPPSTAVEYQPHHRHHPPPPPPPPPPRSPNSASPPPISSSYMLLSLSGTNNNNNNLASFSDLNFSAGNNHHHHHQHTLHGSRKRFRTKFSQFQKEKMHEFAERVGWKMQKRDEDDVRDFCRQIGVDKSVLKVWMHNNKNTFNRRDIAGNEIRQIDNGGGNHTPILAGEINNHNNGHHGVGGGGELHQSVSSGGGGGGFDSDSGGANGGNVNGSSSS

SEQ ID NO: 47 - DNA, 914 bp, Arabidopsis thaliana
  G2991  Predicted polypeptide sequence is paralogous to G2999
aagtttacaaaacatttcttcttcttgtttttcgaaaccctaaatgttttgagttgtcatggatgtaatagctactacaactactatagtatccgacttggattcacgacaacccgaaatcgaagctccgatccggatccagcccgcgaagcctatttctttctcaaacggcaaacgctgccaccaccatcatcttgcatctgaagcggttgcggttgcgacttataaagaatgtctaaagaatcacgcagcaggtatcggcggtcacgctttagacggatgcggcgagtttatgccgtcaccgtcgtttaactccaatgaccccgcttcactaacgtgcgctgcttgtggttgccaccgtaacttccaccgccgtgaggaggatccatcttctctctctgccatcgtccctgcgatcgaatttcgacctcacaaccgtcaccagcttcctccaccgcctcctcctcatctggcggggattcgtagtccagacgacgatgattcagcttctccaccgccgatctcgtcttcttacatgcttctcgcactctctggaggaagaggaggagctaacacggcggttccaatgtctaggaaacgttttaggacgaagtttagtcagtatcagaaggagaagatgttcgagttctcggagagagttgggtggaggatgccgaaagctgatgacgtggtggttaaggagttttgtcgggagattggagttgataaaagcgttttcaaagtgtggatgcataacaacaagatttcaggacgcagcggcgctagaagagctaacggcggagtagtagtaggaggagtaggagatagtcgtcagagtgttgttccgacaaatgggtcgttttcttcgacgtgaggaaaagaatggaaagcgttgaaaaagcgtcgtcgtttta

SEQ ID NO: 48 - protein, 271 aa, Arabidopsis thaliana
  G2991 polypeptide  Paralogous to G2999
MDVIATTTTIVSDLDSRQPEIEAPIRIQPAKPISFSNGKRCHHHHLASEAVAVATYKECLKNHAAGIGGHALDGCGEFMPSPSFNSNDPASLTCAACGCHRNFHRREEDPSSLSAIVPAIEFRPHNRHQLPPPPPPHLAGIRSPDDDDSASPPPISSSYMLLALSGGRGGANTAVPMSRKRFRTKFSQYQKEKMFEFSERVGWRMPKADDVVVKEFCREIGVDKSVFKVWMHNNKISGRSGARRANGGVVVGGVGDSRQSVVPTNGSFSST

SEQ ID NO: 49 - DNA, 729 bp, Arabidopsis thaliana
  G2992  Predicted polypeptide sequence is paralogous to G2999
atggatttgtcttccaaaccacaacaacaacttctaaactctcttcccatcgccggagaactaactgtcaccggagaaatgggtgtttgttacaaagagtgtttgaaaaaccacgcggctaatctcggcggccatgctctcgacggttgcggcgagtttatgccgagtcccacggctacttccaccgatccttcttctctccgttgcgctgcttgtggctgccaccgtaacttccaccgccgtgacccttccgagaatctcaacttcctcaccgcgcctccgatttcttctccctccggcactgagtcgccgccgtctcgtcacgtgtcttctcctgttccttgctcttactacacctcagctcctccacatcacgtgattctctctctcagctccggtttccctggaccgtcagatcaagatccaacggtggttaggtcagagaacagttcaagaggagcaatgaggaaacgaacaagaaccaaattcacgccggagcagaagatcaagatgagagccttcgcagagaaagctggttggaaaatcaacggatgtgatgaaaagtcggtgagagagttttgtaacgaagttgggattgagagaggagttcttaaagtgtggatgcataacaacaagtactcacttctcaatggcaagatcagagagatcgaacatggcctgtgtctgaacactcacagcaatgatggtgatgggtcttcatcttcttga

SEQ ID NO: 50 - protein, 242 aa, Arabidopsis thaliana
  G2992 polypeptide  Paralogous to G2999
MDLSSKPQQQLLNSLPIAGELTVTGEMGVCYKECLKNHAANLGGHALDGCGEFMPSPTATSTDPSSLRCAACGCHRNFHRRDPSENLNFLTAPPISSPSGTESPPSRHVSSPVPCSYYTSAPPHHVILSLSSGFPGPSDQDPTVVRSENSSRGAMRKRTRTKFTPEQKIKMRAFAEKAGWKINGCDEKSVREFCNEVGIERGVLKVWMHNNKYSLLNGKIREIEHGLCLNTHSNDGDGSSSS

SEQ ID NO: 51 - DNA, 1144 bp, Arabidopsis thaliana
  G2993  Predicted polypeptide sequence is paralogous to G2999
tctctttctctctctctctctctctctctttatcttctttcttcaaagtctatcactttataaaaccctaattaaatctctaaactccttagcctctctctattctcagaaccttgtggttattctcaagaaaggtttcattttgagataaagtttgctgctctttctggttgtggatagatcaaaagaatggagattgcaagtcaagaagatcctattccaataaacactagttatggtaatagtggaggtgggcatgggaacatgaaccatcatcatcatgccaattctgcaccatcatctctcaacattactacttcaaacccactactagtctcctcaaatagtaatggtcttggtaaaaatcatgatcattctcatcatcatcatgtgggttacaacatcatggttaccaacatcaagaaagagaagcctgtggtgataaagtacaaggaatgcctaaagaaccatgcagctaccatgggaggcaatgccattgatggttgtggagagtttatgccaagtggtgaagaaggttccattgaagctctcacttgctcagtttgcaactgccatagaaactttcatagaagagaaaccgaaggtgaagagaaaacattcttttccccttacctcaaccaccaccaaccacctccgcagcagagaaaactcatgttccaccacaagatgatcaaatcaccattaccacaacaaatgataatgcctattggcgttacaaccgctggatccaactcagagtcagaggatcttatggaggaagaaggcggaggaagcttgacattccggcagccaccaccaccaccatcaccgtatagttacggacataatcagaagaaaaggtttaggacaaagtttacacaagagcaaaaggagaagatgattagttttgcggaaagagttggttggaagattcagagacaagaggaatctgttgttcaacagctttgtcaagagattggaattaggagaagagttcttaaagtttggatgcacaacaacaaacaaaatctctccaagaagagcaacaacgttagtaacaatgtcgacctttctgctggtaataacgacattactgaaaatcttgcttctactaatccttagttaagttcagattgttgttata

SEQ ID NO: 52 - protein, 310 aa, Arabidopsis thaliana
  G2993 polypeptide  Paralogous to G2999
MEIASQEDPIPINTSYGNSGGGHGNMNHHHHANSAPSSLNITTSNPLLVSSNSNGLGKNHDHSHHHHVGYNIMVTNIKKEKPVVIKYKECLKNHAATMGGNAIDGCGEFMPSGEEGSIEALTCSVCNCHRNFHRRETEGEEKTFFSPYLNHHQPPPQQRKLMFHHKMIKSPLPQQMIMPIGVTTAGSNSESEDLMEEEGGGSLTFRQPPPPPSPYSYGHNQKKRFRTKFTQEQKEKMISFAERVGWKIQRQEESVVQQLCQEIGIRRRVLKVWMHNNKQNLSKKSNNVSNNVDLSAGNNDITENLASTNP

SEQ ID NO: 53 - DNA, 1083 bp, Arabidopsis thaliana
  G2994  Predicted polypeptide sequence is paralogous to G2999
ccccaaaccaagaaacaatttgcaaagagaaagcaaaaggtttttgaagaagacccaattaaaaaagatggaaattgcaagtcaagaagatcatgatatgcccatcccattaaacactacatttggtggtggtggtagtcatggtcacatgatccatcatcatgatcatcatgctgctaattctgctcctccaactcacaacaacaacaatactactcaaccacctccaatgccgttacatggtaatggtcatggcaacaattatgatcatcatcatcatcaagatcctcatcatgttggttacaacgctatcatcaagaagcctatgataaagtacaaggagtgtctcaagaaccatgcagcagctatgggaggcaatgctactgatgggtgtggagagtttatgccaagtggtgaagatggctccattgaggctctcacttgctcagcttgcaattgccacaggaacttccatagaaaagaagtggaaggcgaactcgcagccaccgccatgtccccttaccaccaacaccctccacaccgaaaactcatgctcaaccaccaaaagatcagatcagctatgccacaccaaatgatcatgcccattggagtctctaactaccggtacatgcataacaactccgagtccgaggactttatggaggaagatggcgtaaccaccgcatctagatcgctaccaaacctgccatacaaccagaagaagaggttcaggacaaagttcacgccggaacagaaggagaagatgcttagttttgctgagaaagttgggtggaaaatacaaaggcaagaagattgtgttgttcaaaggttttgtgaagagattggagtgaagagaagagtgcttaaggtttggatgcacaacaacaagatccatttctccaagaagaacaacattaacctcgaagacaacgacaacgaaaagatcaacaatctcaacaatgttgatctgtccggtaataacgacatgactaagatcgtcccatgatataattaataacgttatttttatatgatctttgataattatttagttatctttatgttagctactagggttttaat

SEQ ID NO: 54 - protein, 312 aa, Arabidopsis thaliana
  G2994 polypeptide  Paralogous to G2999
MEIASQEDHDMPIPLNTTFGGGGSHGHMIHHHDHHAANSAPPTHNNNNTTQPPPMPLHGNGHGNNYDHHHHQDPHHVGYNAIIKKPMIKYKECLKNHAAAMGGNATDGCGEFMPSGEDGSIEALTCSACNCHRNFHRKEVEGELAATAMSPYHQHPPHRKLMLNHQKIRSAMPHQMIMPIGVSNYRYMHNNSESEDFMEEDGVTTASRSLPNLPYNQKKRFRTKFTPEQKEKMLSFAEKVGWKIQRQEDCVVQRFCEEIGVKRRVLKVWMHNNKIHFSKKNNINLEDNDNEKINNLNNVDLSGNNDMTKIVP

SEQ ID NO: 55 - DNA, 782 bp, Arabidopsis thaliana
  G2995  Predicted polypeptide sequence is paralogous to G2999
cagagtataaacgcactagtgagtgaaataagaatcagacatgagctcgttatcaaaaccaaacagacaatttttgtcaccaacaacaaacaaccaagacaccggcagagaacaaacaatcgcctgcgcccgagatatggttgtcttgtacaacgagtgccttaaaaaccacgcggtcagtctcggaggccacgctcttgacggctgcggtgagttcacaccaaagtcaaccaccatcctcacggaccctccgtcccttaggtgcgatgcttgtggctgccatcgcaacttccaccgtcgtagtccttctgacggcttcagtcagcaccggtcaccaccgtctccgttacagctgcagccactcgcccctgttccgaacttgcttctctctcttagctccggtttctttggaccctcggatcaagaagtcaagaacaaatttacggtggaaagggatgttaggaagactgcgatgattaagaaacataagaggacgaaattcacggcggagcagaaggtgaagatgagaggtttcgcggagagagcggggtggaagattaacggctgggatgagaagtgggtgagagagttttgtagtgaagttggaatagagagaaaagttcttaaggtttggatccacaacaataagtactttaacaacgggaggagcagagacacgacgtcctctatgtctttgaatttgaagttgtagatctctttacagtgatgggtcttcatcttcttgagataaggaaaaaccgaaacaaaaagaggttacggta

SEQ ID NO: 56 - protein, 191 aa, Arabidopsis thaliana
  G2995 polypeptide Paralogous to G2999
MVVLYNECLKNHAVSLGGHALDGCGEFTPKSTTILTDPPSLRCDACGCHRNFHRRSPSDGFSQHRSPPSPLQLQPLAPVPNLLLSLSSGFFGPSDQEVKNKFTVERDVRKTAMIKKHKRTKFTAEQKVKMRGFAERAGWKINGWDEKWVREFCSEVGIERKVLKVWIHNNKYFNNGRSRDTTSSMSLNLKL

SEQ ID NO: 57 - DNA, 886 bp, Arabidopsis thaliana
  G2996  Predicted polypeptide sequence is paralogous to G2999
gtttcacatttctcgacttcttgaatggagtttgaagacaacaacaacaacaacgacgaagagcaagaagaggatatgaatcttcatgaggaagaagaagacgacgacgccgtttacgactctcctcctctctctcgtgttctccccaaagcctcgacagaaagtcatgaaaccaccggaactacttccacaggcggtggcggaggattcatggttgttcacggcggtggagggagcaggtttaggttccgtgagtgtctcaagaaccaagcggtgaacataggaggacacgcggtcgatggttgtggtgagtttatgccagctggaatcgaaggtaccatcgacgctctaaaatgcgccgcttgtggctgtcaccgtaacttccaccgcaaggaattaccttacttccatcacgcgccgccacaacatcagcctcctcctcccccgccagggttttaccgtcttccagctccggttagctaccgaccaccaccgtcacaagctcctcctcttcagctcgctcttccccctccacaaagagagagatcagaagatccaatggagacgtcttcagctgaagcaggaggagggattaggaagaggcataggactaagtttacggctgagcaaaaggaaaggatgttagctttagctgagaggattggatggagaattcagagacaagacgatgaagtgattcagagattttgtcaggagactggtgttccgagacaagttcttaaggtttggttacataacaacaaacacactcttggtaagtcgccttcaccacttcatcatcatcaggctcctcctcctccaccaccacagtcttcgtttcatcatgaacaagaccaaccatgaatcttgaatttctttgatcact

SEQ ID NO: 58 - protein, 279 aa, Arabidopsis thaliana
  G2996 polypeptide  Paralogous to G2999
MEFEDNNNNNDEEQEEDMNLHEEEEDDDAVYDSPPLSRVLPKASTESHETTGTTSTGGGGGFMVVHGGGGSRFRFRECLKNQAVNIGGHAVDGCGEFMPAGIEGTIDALKCAACGCHRNFHRKELPYFHHAPPQHQPPPPPPGFYRLPAPVSYRPPPSQAPPLQLALPPPQRERSEDPMETSSAEAGGGIRKRHRTKFTAEQKERMLALAERIGWRIQRQDDEVIQRFCQETGVPRQVLKVWLHNNKHTLGKSPSPLHHHQAPPPPPPQSSFHHEQDQP

SEQ ID NO: 59 - DNA, 895 bp, Arabidopsis thaliana
  G2997  Predicted polypeptide sequence is paralogous to G2999
atactcttaactctcatgaattattggtctctctattatagttttttaagtaacaatctaattgtagtacggatgtctcttgagatgttcaagaattaagaaataaagaaagagggatcggagaatgaattttgaggatcaagaagaagatatggagatgtcaggtgttaatcccccctgcggttacgactctctaagcggtgagggagccacatctagtggtggtggaggagtaggaaggagtaaaggagttggagcgaagataaggtatagagagtgcttgaagaaccatgctgttaacataggtggccacgccgtggacggttgttgcgagtttatgccttccggtgaagatggaacgctcgacgctcttaagtgtgcagcttgcggctgccaccgcaacttccaccgcaaggaaaccgaaagcatcggcggtagagcccacagagttcccacgtactacaaccgcccgccgcagccgcatcagccgcctggatatcttcatctaacatctcccgcggcgccttacaggccacccgcggcatcgggggacgaggaggatacatcaaatcctagcagcagcggcgggaccacgaagaggtttagaacgaagttcacggcggaacagaaagagaagatgttagcctttgcggagaggttggggtggagaattcagaagcatgatgacgtggcggttgagcagttctgtgcggagactggtgttaggagacaagtgcttaaaatctggatgcataacaacaagaactctcttggtaagaaaccctaattttgctcgagacatgatttaaaacactagaggatcataattgtttctttttttggtatgactcttctgtaactacttctgcttattagttatgttattttttcctgg

SEQ ID NO: 60 - protein, 220 aa, Arabidopsis thaliana
  G2997 polypeptide  Paralogous to G2999
MNFEDQEEDMEMSGVNPPCGYDSLSGEGATSSGGGGVGRSKGVGAKIRYRECLKNHAVNIGGHAVDGCCEFMPSGEDGTLDALKCAACGCHRNFHRKETESIGGRAHRVPTYYNRPPQPHQPPGYLHLTSPAAPYRPPAASGDEEDTSNPSSSGGTTKRFRTKFTAEQKEKMLAFAERLGWRIQKHDDVAVEQFCAETGVRRQVLKIWMHNNKNSLGKKP

SEQ ID NO: 61 - DNA, 930 bp, Arabidopsis thaliana
  G2998  Predicted polypeptide sequence is paralogous to G2999
atggatatgagaagccatgaaatgatagagagaagaagagaagacaatggcaacaacaatggtggtgttgttattagtaacatcattagtactaatattgatgataattgcaatggtaataacaacaacactcgtgtctcttgcaactctcaaaccctagatcaccaccaatccaagtctccctcttcgttttccatctccgccgcagctaaacccaccgtaagataccgtgagtgtctaaagaatcatgcggcgagcgtcggcggaagtgttcacgacggatgcggcgagtttatgccgagtggtgaagaaggaacaatcgaagctctcagatgcgctgcttgtgattgtcaccgtaatttccaccggaaagaaatggacggcgttggaagctcggatttgatctctcaccaccgtcatcaccactaccaccataaccaatacggtggaggaggagggagaagacctccgccgccgaatatgatgcttaacccactcatgcttcctccgccaccgaattatcagccgattcaccaccacaagtatggaatgagtcctcccggaggaggaggaatggtgacgccgatgagcgttgcttacggcggtggaggaggaggagctgagtcgtctagtgaagatctgaatctgtacggacaatcaagcggagaaggagctggtgcggcggcgggacaaatggcgttttcgatgtcgtcgtctaagaaaagattcaggacaaagttcacgacggatcagaaggagaggatgatggactttgcggagaagctagggtggaggatgaacaagcaagacgaagaagagcttaagagattctgcggcgagatcggagtgaagagacaagtcttcaaagtttggatgcataacaacaagaacaatgctaagaaaccaccaacaccaacaactactctctaa

SEQ ID NO: 62 - protein, 309 aa, Arabidopsis thaliana
  G2998 polypeptide  Paralogous to G2999
MDMRSHEMIERRREDNGNNNGGVVISNIISTNIDDNCNGNNNNTRVSCNSQTLDHHQSKSPSSFSISAAAKPTVRYRECLKNHAASVGGSVHDGCGEFMPSGEEGTIEALRCAACDCHRNFHRKEMDGVGSSDLISHHRHHHYHHNQYGGGGGRRPPPPNMMLNPLMLPPPPNYQPIHHHKYGMSPPGGGGMVTPMSVAYGGGGGGAESSSEDLNLYGQSSGEGAGAAAGQMAFSMSSSKKRFRTKFTTDQKERMMDFAEKLGWRMNKQDEEELKRFCGEIGVKRQVFKVWMHNNKNNAKKPPTPTTTL

SEQ ID NO: 63 - DNA, 1064 bp, Arabidopsis thaliana
  G3000  Predicted polypeptide sequence is paralogous to G2999
atgggtgataggaaacaaacacacatacgtcatcatcatccttaatttctatttctccttcttcttcatcatcaatatcaatctcatcttccactactcctcccctctaacaataagcagcatctctataatccctaagattcacaatggagcttggaggaaaatgcaatgcaattacaaccacaacaatgatctcaacagaagtaaagccacatacggatccggaaccagaagccaaacccgaatcagatccatccatggctttattcccgatcaagaaagaaaaccaaaaaccaaagacacgtgtcgaccaaggagctaagtaccgggaatgtcagaagaaccacgcggcctcaaccggaggacacgtggtggacggatgctgcgagttcatggccggcggagaagaaggtacactcggtgctttaaaatgcgccgcctgtaactgtcaccggagcttccaccggaaagaagtgtacggacacaggaacagtaaacaagatcatcagctgatgataactccggcgttttacagcagtaacagctcgtacaagccacgtgtaatgcatccaacgggtgagattggacggaggacttcatcttcaagcgaggatatgaagaagattctgagtcatcgtaaccaaaacgttgatgggaaaagtttgatgatgatgatgatgaggaagaagaagagagtgaggacaaagatcaatgaagaacaaaaggagaagatgaaggaatttgcagagagattagggtggaggatgcagaagaaagatgaagaagagattgataagttttgtaggatggtgaatctgaggagacaagtttttaaggtttggatgcataataacaagcaagcaatgaagagaaacaatagtaacattagtgaatagtttgatgatctgataaaagtgaaataaatttttacaatcctgttttgcttttatatataatttttgcccttcaaattattcaaaatcttgagtataaatctgtggaatcttgtatgttttgattgttttatattgtatctgggattatttttttcttttactaaaaaa

SEQ ID NO: 64 - protein, 249 aa, Arabidopsis thaliana
  G3000 polypeptide  Paralogous to G2999
MELGGKCNAITTTTMISTEVKPHTDPEPEAKPESDPSMALFPIKKENQKPKTRVDQGAKYRECQKNHAASTGGHVVDGCCEFMAGGEEGTLGALKCAACNCHRSFHRKEVYGHRNSKQDHQLMITPAFYSSNSSYKPRVMHPTGEIGRRTSSSSEDMKKILSHRNQNVDGKSLMMMMMRKKKRVRTKINEEQKEKMKEFAERLGWRMQKKDEEEIDKFCRMVNLRRQVFKVWMHNNKQAMKRNNSNISE

SEQ ID NO: 65 - DNA, 862 bp, Arabidopsis thaliana
  G3001  Predicted polypeptide sequence is paralogous to G2999
gaactcattttctctcttcttcttcatcatcatcatcaatggatgagataaaaccaaagaaagaagagaattccaaacgacgtcgtaacgtcaaacccatttgccgtgaaactggagaccacgtccattatcttccaacatgcaaaaccaagcccaaacccacgcgtactcatcacgcgccaccaccgatcctcgactcaatcttcaaagtcactcacaagccacactactacgaatgcaggaagaatcacgccgctgatatcggaaccaccgcttacgacggctgcggcgagtttgttagctccaccggtgaagaagattctttaaactgcgccgcatgtggctgtcaccgtaacttccaccgtgaagagttaatcccggagaacggcggcgttactgagacggttcttgaagttctcaagatttcatcgtgtcagtttcgtcggatcttttgctcaccttacggcggtggaaaaagcgaaggaaagaagaagaagaaggagaaggagagttatggaggggatccgataattaaagatcgattcggcggtgcggaggaggaggaggggatagtgaagaggttgaaaacgaagttcacggcggagcaaacggagaaaatgagggattatgcggagaagcttcggtggaaggtgagacctgagaggcaggaggaggttgaagagttttgtgtagagattggagtgaatcggaagaattttaggatttggatgaataatcacaaggataaaattataattgatgaatgattatttaccaaacttaattgtgttacttttcttttcattctactttgttttaatttgtgtttgatttagtgtaatgtataaataacaagctcatt

SEQ ID NO: 66 - protein, 242 aa, Arabidopsis thaliana
  G3001 polypeptide  Paralogous to G2999
MDEIKPKKEENSKRRRNVKPICRETGDHVHYLPTCKTKPKPTRTHHAPPPILDSIFKVTHKPHYYECRKNHAADIGTTAYDGCGEFVSSTGEEDSLNCAACGCHRNFHREELIPENGGVTETVLEVLKISSCQFRRIFCSPYGGGKSEGKKKKKEKESYGGDPIIKDRFGGAEEEEGIVKRLKTKFTAEQTEKMRDYAEKLRWKVRPERQEEVEEFCVEIGVNRKNFRIWMNNHKDKIIIDE

SEQ ID NO: 67 - DNA, 721 bp, Arabidopsis thaliana
  G3002  Predicted polypeptide sequence is paralogous to G2999
ccctaaacgcaaaaatcattactcaaaaaaaaacaaagtctctctcttctaattagagagccaagaagatgcagagtacttgtgtctacagagaatgcatgcgcaaccacgccgcgaagctcggctcttacgccatcgatggctgccgtgaatactctcaaccatccaccggcgatctctgcgtcgcctgtggttgccaccgcagctaccaccgtcgtatagacgtcatatcttctcctcaaatcaatcacacgcgcttcccgttcacgagcttaaggcgcgtgaagcagctggcgaggctgaaatggaaaacggctgaggaaagaaatgaggaggaggaggatgacacggaggagacttcgacggaagagaagatgacggtgcagaggcggaggaagtcaaagttcacggcggagcagagagaggcgatgaaagattacgcggcgaagttgggatggacgttgaaggataagagagcgcttagagaagagataagagtcttctgtgaagggattggtgttactcgttatcattttaaaacttgggttaacaataataaaaagttttatcactaactaattaactaatatccttaattgagataatactataatttagttccaatttcattttcatcccttctgtgttaatttctcctccttgatcgcttattttaatggattattattttatcaaaaaaaaaaaaaaaaaaaaaaaaaaa

SEQ ID NO: 68 - protein, 168 aa, Arabidopsis thaliana
  G3002 polypeptide  Paralogous to G2999
MQSTCVYRECMRNHAAKLGSYAIDGCREYSQPSTGDLCVACGCHRSYHRRIDVISSPQINHTRFPFTSLRRVKQLARLKWKTAEERNEEEEDDTEETSTEEKMTVQRRRKSKFTAEQREAMKDYAAKLGWTLKDKRALREEIRVFCEGIGVTRYHFKTWVNNNKKFYH

SEQ ID NO: 69 - DNA, 579 bp, Oryza sativa (japonica cultivar-group)
  G3380 Predicted polypeptide sequence is orthologous to G1792 Orthologous to G1792
ggtccgatccgtaacagtagtagctagttaatttgattattgtccgtccgcggccggtcagtggtcgcaatcgatcgatcgatatcatggacggcgacggcggcggcggatgggacgatcagggcaacggcggcggcgagacgaccaagtaccgtggcgtgcgtcgccggccttctggcaagttcgcggcggagatccgtgactccagcaggcagagcgtccgcgtctggctgggaaccttcgacaccgccgaggaggctgcgcgggcttacgaccgcgccgcctacgccatgcgcggccacctcgccgtcctcaacttccctgctgaggcgcgcaactacgtgcggggatcaggctcgtcgtcctcgtcccgacagcatcagcagcggcaggtgatcgagctggagtgcctagacgaccaagtgctgcaagagatgctcaagggtggcgacgatcagtacaggtcagcagctgggagcaagaggaataactactagctatatatgctgctaacctacttacaatcgcgatacatatcgaggtttggggattttcttctcacctgtgtgcagaggctgc

SEQ ID NO: 70 - protein, 136 aa, Oryza sativa (japonica cultivar-group)
  G3380 polypeptide  Orthologous to G1792
MDGDGGGGWDDQGNGGGETTKYRGVRRRPSGKFAAEIRDSSRQSVRVWLGTFDTAEEAARAYDRAAYAMRGHLAVLNFPAEARNYVRGSGSSSSSRQHQQRQVIELECLDDQVLQEMLKGGDDQYRSAAGSKRNNY

SEQ ID NO: 71 - DNA, 514 bp, Oryza sativa (japonica cultivar-group)
  G3381 Predicted polypeptide sequence is orthologous to G1792
atcgatcatctgctacgaactcaccctatatatatatactccatcttaggagctgcttgatcgatcgacatatatataactaatggatcatcatcatcagcagcagcagcaggagggtgagctggtggccaagtacaggggcgtgcggcggcggccgtggggcaaattcgcggcagagatccgcgactcgagccggcacggcgtccgcgtgtggctgggcaccttcgacacagccgaggaggccgctcgcgcctacgaccgctccgcctactccatgcgcggcgccaacgccgtcctcaacttccccgccgacgcccacatctacgcccgtcaactacacaataataacgccgctgctggctcttcatcttcctcttccgccgccgccgcagcagccaggccgccgccgatcgagttcgagtacctcgatgaccacgtcctgcaggagatgctccgagaccacaccaccaacaagtagcttactactccactatatatgctgcctgctgcttgt

SEQ ID NO: 72 - protein, 131 aa, Oryza sativa (japonica cultivar-group)
  G3381 polypeptide  Orthologous to G1792
MDHHHQQQQQEGELVAKYRGVRRRPWGKFAAEIRDSSRHGVRVWLGTFDTAEEAARAYDRSAYSMRGANAVLNFPADAHIYARQLHNNNAAAGSSSSSSAAAAAARPPPIEFEYLDDHVLQEMLRDHTTNK

SEQ ID NO: 73 - DNA, 375 bp, Oryza sativa (japonica cultivar-group)
  G3383 Predicted polypeptide sequence is orthologous to G1792
atggaggacaaccggagcaaggacacggcgaccaagtaccgcggcgtgaggaggcggccgtggggcaagttcgcggcggagatccgcgacccggagcgcggcggggcgcgcgtctggctcggcaccttcgacaccgccgaggaggcggcgcgtgcctacgaccgcgcggcctacgcccagcgcggcgccgccgccgtgctcaacttcccggccgccgccgccgccggcaggggtggaggagccggcggcgccgcttccgggtcgtcgtcgtcgtcgtccgcgcagcgcggcaggggcgacaagatcgagttcgagtacctcgacgacaaggtgctcgacgatctcctcgacgacgagaagtaccgtggtaaatga

SEQ ID NO: 74 - protein, 124 aa, Oryza sativa (japonica cultivar-group)
  G3383 polypeptide  Orthologous to G1792
MEDNRSKDTATKYRGVRRRPWGKFAAEIRDPERGGARVWLGTFDTAEEAARAYDRAAYAQRGAAAVLNFPAAAAAGRGGGAGGAASGSSSSSSAQRGRGDKIEFEYLDDKVLDDLLDDEKYRGK

SEQ ID NO: 75 - DNA, 466 bp, Oryza sativa (japonica cultivar-group)
  G3515 Predicted polypeptide sequence is orthologous to G1792
gtgtgcgagcggttgcgtccgcatggaggacgacaagagtaaggaggggaaatcgtcgtcgtcgtaccgcggcgtgcggaagcggccgtggggcaagttcgcggcggagatccgcgacccggagcgcgggggagcccgcgtgtggctcggcacgttcgacaccgcggaggaggccgcgcgggcgtacgaccgcgccgcattcgccatgaagggcgccacggccatgctcaacttcccgggagatcatcatcacggcgccgcaagcaggatgaccagcaccggctcttcttcgtcctccttcaccacgcctcctccggcgaactcctccgcggcggcgggccgcggcggctccgatcggacgacggacaaggtggagctggagtgcctcgacgacaaggtcctggaggacctcctcgcggagaccaactatcgtgataagaactactagctagctagctactatggc

SEQ ID NO: 76 - protein, 141 aa, Oryza sativa (japonica cultivar-group)
  G3515 polypeptide  Orthologous to G1792
MEDDKSKEGKSSSSYRGVRKRPWGKFAAEIRDPERGGARVWLGTFDTAEEAARAYDRAAFAMKGATAMLNFPGDHHHGAASRMTSTGSSSSSFTTPPPANSSAAAGRGGSDRTTDKVELECLDDKVLEDLLAETNYRDKNY

SEQ ID NO: 77 - DNA, 393 bp, Zea mays
  G3516 Predicted polypeptide sequence is orthologous to G1792
atggaggacgacaagaaggagggcaagtaccgcggcgtgcggaagcggccgtggggcaagttcgccgcggagatccgggacccggagcgcggcggctcccgcgtctggctcggcaccttcgacaccgccgaggaggccgccagggcctacgaccgcgccgcattcgccatgaagggcgccacggccgtgctcaacttccccgccagcggaggatcgtcagctggcgcggctcccggcggccggaccagcggcggctcctcctcgtccaccacgtcggctccggccagcagggggagggcccgtgttcccgactcggagaaggtggagctggagtgcctcgacgacagggtcttggaagagctgctcgcggaagacaagtacaacaagaactaa

SEQ ID NO: 78 - protein, 130 aa, Zea mays
  G3516 polypeptide  Orthologous to G1792
MEDDKKEGKYRGVRKRPWGKFAAEIRDPERGGSRVWLGTFDTAEEAARAYDRAAFAMKGATAVLNFPASGGSSAGAAPGGRTSGGSSSSTTSAPASRGRARVPDSEKVELECLDDRVLEELLAEDKYNKN

SEQ ID NO: 79 - DNA, 477 bp, Zea mays
  G3517 Predicted polypeptide sequence is orthologous to G1792
tacgtccgatccacagccatcatcgccacccgcgcgcttatggatggcgagtggtccaaggacggcggaggcggcgagccgaccaagtaccgcggcgtgcggcgtcggccctggggcaagtacgcggcggagatccgcgactcgagccggcacggcgtccgcatctggctcggcacgttcgacaccgccgaggaggccgccagggcgtacgaccgctccgccaactccatgcgcggcgccaacgccgtgctcaacttcccggaggacgcgcccgcctacgccgccgccgcctcccgtggctccgccggcggatcctcgtccagaccggcgggctccggccgggacgtgatcgagtttgagtacctcgacgacgaggtgctgcaggagatgctcaggagccaggagccgtcggcggcggcggcgcagaagaagaagtagcgcgagcgccacaggtggcgaaacggccgcttttccaaa

SEQ ID NO: 80 - protein, 132 aa, Zea mays
  G3517 polypeptide  Orthologous to G1792
MDGEWSKDGGGGEPTKYRGVRRRPWGKYAAEIRDSSRHGVRIWLGTFDTAEEAARAYDRSANSMRGANAVLNFPEDAPAYAAAASRGSAGGSSSRPAGSGRDVIEFEYLDDEVLQEMLRSQEPSAAAAQKKK

SEQ ID NO: 81 - DNA, 717 bp, Glycine max
  G3518 Predicted polypeptide sequence is orthologous to G1792
ctaacacacataacaataacttagcaacattttttccttccttctttctttctttctatactttttgttgttaattctaagttctaagagaagaaaaatggagggtggaagatcatcagtttcaaatgggaatgttgaggttcgttatagagggattagaagaaggccatggggaaagtttgcagcagagattcgtgaccctacaaggaaaggaacaaggatatggcttggaacatttgacactgctgaacaagctgcacgagcttatgatgctgctgcttttcattttcgtggccacagagcaattctcaacttcccaaatgagtatcaatctcataatccaaactcttctttgcctatgcctctagctgtgtcagctcctccttcttattcttcttcttcttccacttctaattattccggtgatgataataataaccaccttgtgagaccagctttttctggagaaataatgcaaggtggtgatcatgatgatgatacttttgagttggagtacttcgataataagttgctcgaggaactccttcagatgcaagataacagacacttctaaaagtaaaatataacacaagccagctatgttgtgttagtcactggcatgaaataaaatgcaaagaaatattgttgattttatttaatatattttgtttgatttttttttttttttttgtagctgatcaaagttcttcgaaatga

SEQ ID NO: 82 - protein, 158 aa, Glycine max
  G3518 polypeptide  Orthologous to G1792
MEGGRSSVSNGNVEVRYRGIRRRPWGKFAAEIRDPTRKGTRIWLGTFDTAEQAARAYDAAAFHFRGHRAILNFPNEYQSHNPNSSLPMPLAVSAPPSYSSSSSTSNYSGDDNNNHLVRPAFSGEIMQGGDHDDDTFELEYFDNKLLEELLQMQDNRHF

SEQ ID NO: 83 - DNA, 609 bp, Glycine max
  G3519 Predicted polypeptide sequence is orthologous to G1792
tttctttctttctatactttttgtggttctgattattaagttctaagagaataacaatggagggtggaagatcatctgtttcaaatgggaattgtgaggttcggtatagagggattagaagaaggccatggggcaagtttgcagcagagattcgtgaccctacgaggaaagggacaaggatatggcttggaacatttgacactgcggaacaagctgctcgagcttatgatgctgctgcttttcattttcgtggtcatagagcaattctcaacttcccaaatgagtaccaatctcataatccaaactcttctttgcctatgcctctaattgtgcctcctccttcttattcttcttctttcacttctaattattctgctgatgataataaccaccttgtgagacctggagaaataatgcaaggtggtgatcttgatgacacttttgagttggagtacttggataataagttgctcgaggaactccttcagatgcaagataacagacacttctaaaagtaaaatataacacaagccagctatgttgtgttagtcactggcatgaaataaaatgcaaagaaatattgttgattttatttaatatattttgttt

SEQ ID NO: 84 - protein, 151 aa, Glycine max
  G3519 polypeptide  Orthologous to G1792
MEGGRSSVSNGNCEVRYRGIRRRPWGKFAAEIRDPTRKGTRIWLGTFDTAEQAARAYDAAAFHFRGHRAILNFPNEYQSHNPNSSLPMPLIVPPPSYSSSFTSNYSADDNNHLVRPGEIMQGGDLDDTFELEYLDNKLLEELLQMQDNRHF

SEQ ID NO: 85 - DNA, 440 bp, Glycine max
  G3520 Predicted polypeptide sequence is orthologous to G1792
aaggcacacaatggaagaggagtcaaaggagaaaaagaaggacactaaggaggaaccacgttatagaggagtgcggcggcggccgtgggggaagttcgcggccgagattcgggacccggcccggcacggtgcccgagtgtggctggggacatttctcacggcggaggaggctgctagggcttatgaccgagctgcctatgagatgaggggcgctttagccgttctcaattttccaaatgagtatccttcatgctcttctatgaactcatcttcaacattagcaccttcatcttcttcttcaaattcaatgcttaaaagtgatcatggtaaacaagttattgagttcgagtgcttggatgacaaattgttagaggaccttcttgattgtgatgactatgcctacgagaaagacttgcctaagaactgaacggtttgatcaa

SEQ ID NO: 86 - protein, 138 aa, Glycine max
  G3520 polypeptide  Orthologous to G1792
MEEESKEKKKDTKEEPRYRGVRRRPWGKFAAEIRDPARHGARVWLGTFLTAEEAARAYDRAAYEMRGALAVLNFPNEYPSCSSMNSSSTLAPSSSSSNSMLKSDHGKQVIEFECLDDKLLEDLLDCDDYAYEKDLPKN

SEQ ID NO: 87 - DNA, 1082 bp, Glycine max
  G3643 Predicted polypeptide sequence is orthologous to G47
ccacgcgtccgcttcttctctcagaatacacaacacaaagtcaatataattatagtatatccctatgagtaggagttcggcgatgcatggaattacaagcacaaacaacaagttgaagggagttcggcgtcgaaaatggggcaaatgggtgtcggagattcgtgttccgggcacgcaagagcgtttgtggttgggaacctacgccacgccggaggctgccgcggtggctcacgacgttgccgtctactgtctaagtaggccttcttcgttggacaaacttaacttccccgaaaccttgtcttcgtacagtgttcagctcagggacatgtctccgaggtctgtgcagaaggtggcttccgatgttggcatggatgttgatgcaagaaacattgttgcgggcaaaacttcaacggtgggggcagaaactaattgcgagagtgatgagaggactagtactgcgtctgtgtgtaatgttgttggagaaggtggtgctgatcattcggatgtgttttggtgggatgatgatggtgggtcttggcatggaagtggtggagattctacggaaagggatgccttgagcatttccattgaagattatctttagctgttctaggtttcaactttagttatctttttttttttttttttgagttatgatcgatgcgcatagttagtagttacagataattactgctagtgttgggtgtttaaacggtcagagatgatgatatataaatttgatgtgcgctagctgcctttttgaagaaactaaaaaaaggtaaaacaagaaagattgtacccccaaaatgaacttggtcaatttcacactttcacgccatttgcattttgtgcacgttgttagttttcaaattgttaattcccttgctaaacccactcaaacttgagtgcgttcaccttttattaccacgtagtaactgagagttaacgaaaatatttctttataaaaattatttaccatttagtgtctttcgtttacttgtaattattcaacttgtcaataagatgaaagttctaattttagatataataaaattcagctagtatttgtgaattactcactt

SEQ ID NO: 88 - protein, 179 aa, Glycine max
  G3643 polypeptide  Orthologous to G47
MSRSSAMHGITSTNNKLKGVRRRKWGKWVSEIRVPGTQERLWLGTYATPEAAAVAHDVAVYCLSRPSSLDKLNFPETLSSYSVQLRDMSPRSVQKVASDVGMDVDARNIVAGKTSTVGAETNCESDERTSTASVCNVVGEGGADHSDVFWWDDDGGSWHGSGGDSTERDALSISIEDYL

SEQ ID NO: 89 - DNA, 687 bp, Oryza sativa (japonica cultivar-group)
  G3644 Predicted polypeptide sequence is orthologous to G47
atgccttttgtacgtacacttgctttcccaacgctcgcgaatcaaatcgagggtgaaattaagtcaagaacggagagagatcacggtgaggttgatctcagctcgccggaggaggcaatgagccgggcggagtgcggcggcggcgaggaggaggagcggtgcaggtacaggggcgtgcggcggcggcggtgggggaagtgggtgtcggagatccgggtgcccggcacgcgggagcggctgtggctggggtcctacgccacgccggaggccgccgccgtcgcgcacgacacggccgtctacttcctccgcggaggcgcgggcgacggcggtggcggcggcgcgacgctcaacttcccggagcgcgcggcggccacgtacggcggcggcgccgccgtggcgcgcctgtcgccgcggtccgtgcagcgcgtggcgtccgacgccggcatggccgccgacgcgcagctcgtggcggcgcgggacgccgcgcccgcgcccgcgccggcgacggcgtacgcgcgcccggatcactgcgccggcgcgacgacggcgcggcacgacgagctggcgcgccgcgggatgtacggcgctcacgcgcatgccgccggcgcgaacgccaggacgagcggcgagcggcagctcgtctgtgccgaggagattagcgtggatgacatggagatcctgatgtaa

SEQ ID NO: 90 - protein, 228 aa, Oryza sativa (japonica cultivar-group)
  G3644 polypeptide  Orthologous to G47
MPFVRTLAFPTLANQIEGEIKSRTERDHGEVDLSSPEEAMSRAECGGGEEEERCRYRGVRRRRWGKWVSEIRVPGTRERLWLGSYATPEAAAVAHDTAVYFLRGGAGDGGGGGATLNFPERAAATYGGGAAVARLSPRSVQRVASDAGMAADAQLVAARDAAPAPAPATAYARPDHCAGATTARHDELARRGMYGAHAHAAGANARTSGERQLVCAEEISVDDMEILM

SEQ ID NO: 91 - DNA, 656 bp, Brassica rapa subsp. Pekinensis
  G3645 Predicted polypeptide sequence is orthologous to G47
cccacgcgtccgatggattacatcgacaacaccgtcgaaactcaatcaaagtacaaaggcatccgtcgccggaaatgggggaaatgggtatcggagattcgagttccgggaactcgcgaccgtctctggttaggctcattctccacggcggaaggcgcagccgtggcgcacgacgtggctttctactgtttacaccaaccaaactcgctcgaatctctcaacttccctcacttgcttcctccttccattgtttccaagacttcgccgaggtctatccagcaagctgcttctaatgccggaatggccgttgacgccggaatcgttaacagctgtgatcacgcgtcagggaactctgggaatggagatacaacgacggcgtattgtgagaatggaggtgcgttgaatatatcagtgtatgattatttggacggtcacgatcacgtttgaacttcatcttcttgttttttcgtttaaagatacagctactcaaaagaagcagtgatggagcctggtgtgtaagcaagcaaaacgttgtgaatatatataccggtatgtttcgctgttggcccaatgcaagaaacttttgtagtacgaatatatatattttattttgaatgccttcaagaggattataatgcgagtgaagctttgtttca

SEQ ID NO: 92 - protein, 144 aa, Brassica rapa subsp. Pekinensis
  G3645 polypeptide  Orthologous to G47
MDYIDNTVETQSKYKGIRRRKWGKWVSEIRVPGTRDRLWLGSFSTAEGAAVAHDVAFYCLHQPNSLESLNFPHLLPPSIVSKTSPRSIQQAASNAGMAVDAGIVNSCDHASGNSGNGDTTTAYCENGGALNISVYDYLDGHDHV

SEQ ID NO: 93 - DNA, 649 bp, Brassica oleracea
  G3646 Predicted polypeptide sequence is orthologous to G47
cagccgcataacatattactattccccctggtcatatctttgacttttatttttatttgctctaacctaaaagtattatataagtattgcacaattcatacaatcggaattgactttcttctcctccaatcgtatttttattcaacagttcctctcaagatcatcaactcaaaaaatggatcctagagacggcggagaaacccatcaggccaagtacaaaggcatccgtcgccggaaatggggaaaatgggtatcggagattagggttccagcaactcgtgaacgactctggttaggctctttctccaccgccgaaggagctgcggtagcccacgacgtcgctttttactgcttgcaccgaccatcttctctcgacaacgaagcttttaacttccctcacttgctgcaaccttcccttgcctccaacacatctcctaagtccatacaaaaagctgcttcggacgcaggcatgggcgtagacgcaggattcgccctaaacaacgacagcgcgagtggtggcgtggaggaaggcaccgaacgggaaacgttgaacatctccgtgtacgattatctagacgacggtcgcatttgatatattggtttatatctacgagcaccttatattagtaattaatataggatgtgaata

SEQ ID NO: 94 - protein, 138 aa, Brassica oleracea
  G3646 polypeptide  Orthologous to G47
MDPRDGGETHQAKYKGIRRRKWGKWVSEIRVPATRERLWLGSFSTAEGAAVAHDVAFYCLHRPSSLDNEAFNFPHLLQPSLASNTSPKSIQKAASDAGMGVDAGFALNNDSASGGVEEGTERETLNISVYDYLDDGRI

SEQ ID NO: 95 - DNA, 495 bp, Zinnia elegans
  G3647 Predicted polypeptide sequence is orthologous to G47
attcgcggccgcgaatatgagtaccagctcagatgaaggtaacaactgtttaagccaaaagacttacaaaggcgttaggtgccgacgatggggcaaatgggtgtcagagattcgagttccaggaagtcgagaacggctctggctaggcacgtactctacgcctgagggtgcagctgtggctcatgatgtagcctcgtactgtttaaaagggaatacgtcttttcataaacttaatattccgtctatgttacctccgacagcacggacagacctatctcctaggtccatccaaaaggctgcgtctgatgctggtatggccatagacgcacggtttatcgcgtctagagataccacaccgactaatgaggcgttgaacatttctgtagatgattatctttaaattttgagaactaatattgtgtcaccaatattgtaagtcgatctacattggcaaacacaatgtacgtgtttggtggcacttccagattattgttt

SEQ ID NO: 96 - protein, 127 aa, Zinnia elegans
  G3647 polypeptide  Orthologous to G47
MSTSSDEGNNCLSQKTYKGVRCRRWGKWVSEIRVPGSRERLWLGTYSTPEGAAVAHDVASYCLKGNTSFHKLNIPSMLPPTARTDLSPRSIQKAASDAGMAIDARFIASRDTTPTNEALNISVDDYL

SEQ ID NO: 97 - DNA, 594 bp, Oryza sativa (japonica cultivar-group)
  G3649 Predicted polypeptide sequence is orthologous to G47
atgggccgggtggcggcgagcggcggcggcggcggcggaggggagatgatgaggtacaggggcgtgcggcggcggcggtgggggaagtgggtgtcggagatccgggtgcccgggacgcgggagcgcctgtggctcggctcctacgccaccgccgaggccgccgccgtcgcgcacgacgccgccgtctgcctcctccggctcggcggcggccgccgcgccgccgcaggcggaggcggcgggctcaacttccccgcccgcgcgctcgccgcggcggcggccgcctcctcctacggcggcgccggcggtctcctgtccccgcgctccgtgcagcgcgtggcgtccgacgccggcatggccgccgacgcgcagctcgtggacctgcgccgcgaccacccgcccgccgccgccgccgcctcatcctccggcagcggcgtggcgggagacggtgcaagaaagcaagggacacgtggcgaggttagcgacacgtattggtgtaggaatggagaggatgggagcagaagccggagctccgggagtgaggagctcattgtttacgagggcttaagtgtagatgacatggaaattttgatgtaa

SEQ ID NO: 98 - protein, 197 aa, Oryza sativa (japonica cultivar-group)
  G3649 polypeptide  Orthologous to G47
MGRVAASGGGGGGGEMMRYRGVRRRRWGKWVSEIRVPGTRERLWLGSYATAEAAAVAHDAAVCLLRLGGGRRAAAGGGGGLNFPARALAAAAAASSYGGAGGLLSPRSVQRVASDAGMAADAQLVDLRRDHPPAAAAASSSGSGVAGDGARKQGTRGEVSDTYWCRNGEDGSRSRSSGSEELIVYEGLSVDDMEILM

SEQ ID NO: 99 - DNA, 702 bp, Oryza sativa (japonica cultivar-group)
  G3651 Predicted polypeptide sequence is orthologous to G47
atggctgacctcccatgcatatatatacgcgtagtacgtacacttgctttcccaacgctcgcgaatcaaatcgagggtgaaattaagtcaagaacggagagagatcacggtgaggttgatctcagctcgccggaggaggcaatgagccgggcggagtgcggcggcggcgaggaggaggagcggtgcaggtacaggggcgtgcggcggcggcggtgggggaagtgggtgtcggagatccgggtgcccggcacgcgggagcggctgtggctggggtcctacgccacgccggaggccgccgccgtcgcgcacgacacggccgtctacttcctccgcggaggcgcgggcgacggcggtggcggcggcgcgaccgctcaacttcccggagcgcgcggcggccaccgtacggcggccgccgtggcgcgcctgtcgccgcggtccgtgcagcgcgtggcgtccgacgcggcatggccgccgacgcgcagctcggcgtgccgggacccggcccggcccgcgccggcgacggcgtacgcgcgcccggatcactgcgccggcgcgacgacggcgcggcacgacgagctggcgcgccgcgggatgtacggcgctcacgcgcatgccgccggcgcgaacgccaggacgagcggcgagcggcagctcgtctgtgccgaggagattagcgtggatgacatggagatcctgatgtaa

SEQ ID NO: 100 - protein, 233 aa, Oryza sativa (japonica cultivar-group)
  G3651 polypeptide  Orthologous to G47
MADLPCIYIRVVRTLAFPTLANQIEGEIKSRTERDHGEVDLSSPEEAMSRAECGGGEEEERCRYRGVRRRRWGKWVSEIRVPGTRERLWLGSYATPEAAAVAHDTAVYFLRGGAGDGGGGGATAQLPGARGGHRTAAAVARLSPRSVQRVASDAAWPPTRSSACRDPARPAPATAYARPDHCAGATTARHDELARRGMYGAHAHAAGANARTSGERQLVCAEEISVDDMEILM

SEQ ID NO: 101 - DNA, 855 bp, Lotus corniculatus var. japonicus
  G3663  Predicted polypeptide sequence is orthologous to G2999
atggaaatgagagagatgccttccactttgatatataatctccccaacagagattcctcttctccatctctaccttcaagtagtgatcagccttctcaaactcacacaataatcttcaatcatccacctaaactttctcataaccaccaccatcatatttataccccttcttctacttctcctcctcttccaccaaactcagttcaacttcaacaacaacccacaagagatccagatccaagttcttcttcttctctattaattagatacagagaatgcctgaggaaccatgcagcgagattagggagtcatgtcacagatggatgtggcgagttcatgccaaatggagaacaaggaaccccagaatcattgatctgtgctgcttgcgagtgccaccgcaattttcacagaaaagaggctcaaggagaacctcaacaagtttccaactatcatcacaacaaaagcaatggtcagaacaggattcacccttcttctctgcatcataaacatggattttcttcgtcaccagggttgatgatgggctttgggggaggcagtggaggccctgcagctgaatcctcaagtgaagatctcaacatgtttcaccagtccaatgatggaggccaattatcagtgcagccaccactatcatcaaagaagaggttcagaactaagttcacccagcaacaaaaggacaggatgatggagtttgctgagaaactggggtggaagatccagaagcaagatgaagaggaagtgaagcaattctgctctcatgttggtgtaaaaagacaggctttcaaggtttggatgcacaatagcaagcaagcaatgaagaagaagcaaatcatgtaa

SEQ ID NO: 102 - protein, 284 aa, Lotus corniculatus var. japonicus
  G3663 polypeptide  Orthologous to G2999
MEMREMPSTLIYNLPNRDSSSPSLPSSSDQPSQTHTIIFNHPPKLSHNHHHHIYTPSSTSPPLPPNSVQLQQQPTRDPDPSSSSSLLIRYRECLRNHAARLGSHVTDGCGEFMPNGEQGTPESLICAACECHRNFHRKEAQGEPQQVSNYHHNKSNGQNRIHPSSLHHKHGFSSSPGLMMGFGGGSGGPAAESSSEDLNMFHQSNDGGQLSVQPPLSSKKRFRTKFTQQQKDRMMEFAEKLGWKIQKQDEEEVKQFCSHVGVKRQAFKVWMHNSKQAMKKKQIM

SEQ ID NO: 103 - DNA, 1162 bp, Flaveria bidentis
  G3668 Predicted polypeptide sequence is orthologous to G2999
gttttttttttttttttttttttttttttttttgtcaaagcagaacagaattgcatacgtaggtaacattgcatacacttgcacactctaaacacacacttttgctttattatttttttttgcaggcgatgggttaattcatgtccacaccctcttctttcacttatcctctgatcaacctcacatcacccaccattgcctctccatcttattcaccatcattcatcctaatctgtttcttaattcacctctcgttgttaatcacatcggagcttataattcactaatggagtttgatgaacacgatgagcaggaagaggaggtcggaattcagctcactccggggagttttgacgccgtcgggaactccggccggaggaaatccggtggcggtggcggtggcggtggatacaggtataaggaatgtttgaagaaccacgcggtaggcattggcggtcaggcggtggacggatgtggagagtttatggctgccggagatgaaggtaccttagatgcactaaagtgcgccgcgtgcaattgtcaccggaacttccatcggaaggaggtggagggacaacaacggcagcatcaacaccagcagcaagctgcgttacagcaccagtatatcaccgcgacgccgtactaccaccaccaccaccggccgacgggatacctgcacatgaaaccgcctccgtcgtcgctccaccagcggcagctggctctcccgtcgacgtctcgagatgatctggatgagatctcaaaccctagctccagcggtggcggtggcgttggtggaagcggttcgaagaagagattccgaacgaaattcacacaggatcagaaggatcggatgctggcgttctcggaggcgttagggtggcgtattcagaagcacgatgaggccgccgtgcaacaattctgcaacgaaaccggcgttaaacgccacgttcttaaggtctggatgcacaataataagcacacaatcggtaagaaaccctaattttgcaacaaaaacgaacaagctacagaaattattaatggaatctcattcgtaggatcgatttcagtgtcgtttaggtagtatttttgtttgatttctatcgttgtgatcgtagtctcttaatttaactcgatctgaatgttgattaatcgtttgatttcc

SEQ ID NO: 104 - protein, 237 aa, Flaveria bidentis
  G3668 polypeptide  Orthologous to G2999
MEFDEHDEQEEEVGIQLTPGSFDAVGNSGRRKSGGGGGGGGYRYKECLKNHAVGIGGQAVDGCGEFMAAGDEGTLDALKCAACNCHRNFHRKEVEGQQRQHQHQQQAALQHQYITATPYYHHHHRPTGYLHMKPPPSSLHQRQLALPSTSRDDLDEISNPSSSGGGGVGGSGSKKRFRTKFTQDQKDRMLAFSEALGWRIQKHDEAAVQQFCNETGVKRHVLKVWMHNNKHTIGKKP

SEQ ID NO: 105 - DNA, 813 bp, Lotus corniculatus var. japonicus
  G3670  Predicted polypeptide sequence is orthologous to G2999
atggagtttgatgagcaagaagagcaagatgaagaaatggggatcccggagtcaccgccgccggtgccggcgagttacgacccgcttttgaactcagcaccgagatccaaaatcgcagaggtttcagcgcctgtaatcgggaggaaaggcggctcgtttaccccgccggtggcagcgggggttgtgaggtacagggaatgccagaagaaccacgccgtcagcttcggcggccacgccgtcgacgggtgctgcgagttcatggctgccggagatgaaggcacgctggaggctgtgatctgcgccgcctgtaactgtcaccggaacttccaccgcaaggagatcgacggcgaaacagtggcctcgtgccagaggcagcagcctccgcctcctccggtgcaccaccaccagtaccacagccaattctccccttactaccaccgtggacctcagcaccatgccgcctccggcggctacctccaccaccacctgacaacatctccgacggcgccccaccggccgttagcacttccaccggcgacttcaggaggtggattcagcagggaggaggaagacatgtctaaccctagcagcagtggtggaggcggcggaggtggaatgaaaaagaggtacaggaccaagttcacgccggagcagaaggagaagatgctggcttttgcagaagagcttggttggagaatccagaagcatcaagaagctgctgttgaacaattctgtgctgaaacttgtgtgaggagaaacgttctcaaggtttggatgcacaataacaagaacacgcttggtaagaaaccctaa

SEQ ID NO: 106 - protein, 270 aa, Lotus corniculatus var. japonicus
  G3670 polypeptide  Orthologous to G2999
MEFDEQEEQDEEMGIPESPPPVPASYDPLLNSAPRSKIAEVSAPVIGRKGGSFTPPVAAGVVRYRECQKNHAVSFGGHAVDGCCEFMAAGDEGTLEAVICAACNCHRNFHRKEIDGETVASCQRQQPPPPPVHHHQYHSQFSPYYHRGPQHHAASGGYLHHHLTTSPTAPHRPLALPPATSGGGFSREEEDMSNPSSSGGGGGGGMKKRYRTKFTPEQKEKMLAFAEELGWRIQKHQEAAVEQFCAETCVRRNVLKVWMHNNKNTLGKKP

SEQ ID NO: 107 - DNA, 1169 bp, Oryza sativa (japonica cultivar-group)
  G3671 Predicted polypeptide sequence is orthologous to G2999
aagtgttttcctagctaggtagctagctagctagacgagcttgccggccggccggccggcgacggcgaccatggacttcgatgaccatgacgacggcgacgaggagatgccgccgatgccggtgagctcgagctacgagactccgccgcagcatggccttgccggcggtgggatggcgcccaagcctcctggtgagattggcagccgtgtgaagggccccagctgcggtggcggcaggtaccgcgagtgcctcaagaaccacgcggttggcatcggcggccacgccgtggacggctgcggcgagttcatggcggccggcgaggagggcaccatcgacgcgctccgctgcgccgcgtgcaactgccaccgcaacttccaccggaaggagtccgagtcgcttgccggcgagggctcgcccttctccccggccgccgtcgtcccctacggcgccacgccgcaccaccagttctccccgtactaccgcacccctgccggttacctccaccaccaccagcaccacatggccgcggcagccgcggccgccgccgccgcagccggcggctacccgcagcggcccctcgcgctcccgtccacctcccacagcggccgcgacgacggcgacgacctgtccgggatggtggggcccatgtcggcggtggggccgctcagcggcatgtccctcggcgccggcccgtccggctccggctccggcaagaagcggttccgcaccaagttcacccaggagcagaaggacaagatgctggcgttcgccgagcgcgtcgggtggcgcatccagaagcacgacgaggccgccgtgcagcagttctgtgacgaggtcggcgtcaagcgccacgtgctcaaggtgtggatgcacaacaacaagcacaccctgggcaagaagctgccatgaccgggagcaaatgcatttgatctcatcgtcggcatgcatgaccaagttgtgggacgacgcatgcatccatgtccatcccaagctagctgagctgatcgaccggccgtggcttagccacccggaccccggtatggtaggtacctgaaccttatttatttagagttggacttaattaattggtggcttaggttaatctgtagcaagagagactgagagagcattcgttctcggctctagtaggtggttctttcttcttttc

SEQ ID NO: 108 - protein, 264 aa, Oryza sativa (japonica cultivar-group)
  G3671 polypeptide  Orthologous to G2999
MPVSSSYETPPQHGLAGGGMAPKPPGEIGSRVKGPSCGGGRYRECLKNHAVGIGGHAVDGCGEFMAAGEEGTIDALRCAACNCHRNFHRKESESLAGEGSPFSPAAVVPYGATPHHQFSPYYRTPAGYLHHHQHHMAAAAAAAAAAAGGYPQRPLALPSTSHSGRDDGDDLSGMVGPMSAVGPLSGMSLGAGPSGSGSGKKRFRTKFTQEQKDKMLAFAERVGWRIQKHDEAAVQQFCDEVGVKRHVLKVWMHNNKHTLGKKLP

SEQ ID NO: 109 - DNA, 1891 bp, Oryza sativa (indica cultivar-group)
  G3674 Predicted polypeptide sequence is orthologous to G2999
aagcttttcttaagctcgccaagaacacacccgagaaatccaaaagggagggaaaagaaagggggtggccggccggtcggtcggtcggcggccatggatttcgacgaccatgacgagggtgacggcgacgaggagatgcctccgatgcctctgagctcgggctacgacgcgccgatgcagcccgggcttggaggtggcggtggcggggtgcccaagccgggaggtggagtcggcggcggcggtggtggtggtggtggtggtggaggaggaggggcgaggtatcgggagtgcctcaagaaccacgccgtcggcatcggcgggcacgccgtggacggctgcggcgagttcatggcttccggcgaggagggctccatcgacgcgctccgctgcgccgcctgcggctgccaccgtaacttccaccgcaaggagtcggagtcccccacgggcgtcgggccggccgagccttccgccgtgtcccccgccgccatctcggcctacggcgcctcgccgcaccaccagttctccccctactaccgcaccccggcagggtacctccaccaccagcagcaccagatggcggccgcggcggcggccgcggccgccgccgcagcgggcggctacccgcagcggcccctcgcgctgccgtccacctcccactcgggacgcgacgagggcgacgacatgtccgggatggtcggccccatggtgattggccccatggtcggcatgtccctcggctccgccggcccctccggctccggctccggcaagaagcggttccgcacaaagttcacgcaggagcagaaggacaagatgctcgccttcgcggagcggctcgggtggcgcatccagaagcacgacgaggccgccgtgcagcagttctgcgaggaggtctgcgtcaagcgccatgtcctcaaggtttggatgcacaacaacaagcacaccctgggcaagaaggcgccatagctaagctaagccaagcaagctcagctcagctcatctcctcccggtgctaggtacctgcactgcaactgcaactgcatgcatcaccatctccatctacttctactacctccttacccgcggctaattagcctttttctttgccttcttttacctcacctgagtagaagcttagctaggttcgtagcgagcaagctgttcttgttggttttaggggaggtggtggttgctgctgctgctgcttttgcatccttccttgtttctttttcgttattttattccattgtggttgggttctttgggcttgtggttgccgtcgttgttgtttcctagtagatgatgacgacgacgtttggtgttgggaaggaagaggacatggatggcgatttgccgatcgatttagatcttgggaatgtagtacttttgtgttgcaattgaaatttccttcctggggatttgggttgctgcacggtttgtttgtttcatcatttcttttcccctatatttcttgtgcttggcacttcatcatcagtagcacttgtagttcgtctagctaacaactagggcagataaagattcagaaaggtcggctgcaactatatgagctgcaacactgttgcattcacatcgatctccctcgcttccaatttccagacctgggcaccaacttgtccatgatccgtccgcttcacctgtctactctgaaattccaatttctctagctaccatgttcgctgcatttttcttccgagttctcgatctcactgtatccgctgcatttactcgtcttccacatctcgcgagcagtgatgccgcattgctgcccatgtgttaggacgcagagcttgcagaagctatagcaatggccggggactttttagaatttagtctatgtgaattcaatgaagcctcgtcctctcttttactc

SEQ ID NO: 110 - protein, 290 aa, Oryza sativa (indica cultivar-group)
  G3674 polypeptide  Orthologous to G2999
MDFDDHDEGDGDEEMPPMPLSSGYDAPMQPGLGGGGGGVPKPGGGVGGGGGGGGGGGGGGARYRECLKNHAVGIGGHAVDGCGEFMASGEEGSIDALRCAACGCHRNFHRKESESPTGVGPAEPSAVSPAAISAYGASPHHQFSPYYRTPAGYLHHQQHQMAAAAAAAAAAAAGGYPQRPLALPSTSHSGRDEGDDMSGMVGPMVIGPMVGMSLGSAGPSGSGSGKKRFRTKFTQEQKDKMLAFAERLGWRIQKHDEAAVQQFCEEVCVKRHVLKVWMHNNKHTLGKKAP

SEQ ID NO: 111 - DNA, 789 bp, Brassica napus
  G3675  Predicted polypeptide sequence is orthologous to G2999
ggtgacgttgaaggattaaaaataaagagggacagagagagagagagataagaaaaatggactttgaggagcaagaagaagaaatggagatgtcaggtgctaaccccaccggaggttacgactctctgagcggcgagggagcgacctcaagcggaggtggtggcggaggaggtagtagaaaaaccgttggagggtcgaaggtaaggtacagagagtgcttaaaaaatcatgccgttaacatcggcggccacgccgtggacggctgctgtgagttcatgccttccggtgaagatggttcactcgacgctctcaagtgtgcagcttgtggctgccaccgcaacttccaccggaaggaaaccgaagtcatgagcggcagggcacacagggttccaacgtactacaaccgtcctcctcagctgccgccgccaggatacctccatttaacgtctccggcggcggcaggacagccttacaagcctcctgcggcctctggggacgaggaggatacgtcgaatccgagcagcagcggcggaacaagggctaagaggtttagaacgaagttcacggcggagcagaaggataagatgttggccttcgcggagaggttgggttggagaattcagaagcatgatgacgcggcggttgagcagttctgtgcggaaactggtgttaggagacaagtgcttaagatttggatgcataacaacaagaactctctgggtaggaaaccctaaaatttcttgtatgatttaagcgcaagagatcatcattgctcctttttctttttgg

SEQ ID NO: 112 - protein, 225 aa, Brassica napus
  G3675 polypeptide  Orthologous to G2999
MDFEEQEEEMEMSGANPTGGYDSLSGEGATSSGGGGGGGSRKTVGGSKVRYRECLKNHAVNIGGHAVDGCCEFMPSGEDGSLDALKCAACGCHRNFHRKETEVMSGRAHRVPTYYNRPPQLPPPGYLHLTSPAAAGQPYKPPAASGDEEDTSNPSSSGGTRAKRFRTKFTAEQKDKMLAFAERLGWRIQKHDDAAVEQFCAETGVRRQVLKIWMHNNKNSLGRKP

SEQ ID NO: 113 - DNA, 1529 bp, Zea mays
  G3680 Predicted polypeptide sequence is orthologous to G2999
ctcgaaggcggccgggctctggccgggccctgacccgtcgtcccatgctaaaagcccagggttaggagctagaggtaatctctctcccccgcggccactccccagtgggcgtgggggcgccgcatggaagccatggacgtcaagtacaagcccgtcatgttccccaacggcgccggcctcaagaagccgaagccggcggcggccgtggcgctggccggggagccgctgtaccgggagtgcctcaagaaccacgccgcgagcctgggcgggcacgccgtcgacggttgcggcgagttcatgccctcgccgggggccaaccccgccgacccgacgtcgctcaagtgcgcggcgtgcgggtgccaccgcaacttccaccgccggacgctggagggttcccctccgccgcccgcgcccgcgccgctggcgctcccgcctccgccgagcgtgatgcacggccagccgcaccgcgcccgggaggagacgcccgaggaccgccacccgggggtcgtcgacgccgacgactccgattccgactcggaaggctcggagtacgacgaggagcggtcggtgtccccgccgccgccgccgcaccacctgctgccggcgccggtggcgcagcagcccccgccaccgtcctacttcccgacggcgccgcacatggtgctctcgctcggttccggcgtgcccgggcccgcggtggcggtatccccggcgcagaggctggccccgacccagctgacgccgtccagcgcgccgccccacgccgggggcgcgatgcccatgcccaggaagcggttccgcaccaagttcaccgccgagcagaagcagcggatgcaggagctgtcggagcggctcgggtggcggctgcagaagcgcgacgaggccatcgtcgacgagtggtgccgcgacatcggcgtcggcaagggcgtcttcaaggtctggatgcacaacaacaagcacaacttcctgggcgggcacagcgcccgccgcagcgcctcctcgcccgcccccgcccccgccgccgcgtcgctccaaaccccagccgccggcgccggcgccggcgctgctgcagcaccgtcattcaacccgtccaggatcacccctccccctcccgtcctcacctcgtccccgacggccgccaccggcttcaacatcaacggcgccgcctcctcggcgcccaccgtcgccaccgactacaccacggacaacgccaacggagcttcgtcgccgcactccgcttgaactagagaagggagaagagaggagggggaagggaagggagagcggagagggagagaaacatgtagcttaatttcagtgatcactcgttttttttttgtttagacctcttgccatctactaagaaattaaccccaagaaaaagcatgccgctgtgcgccatgcctagaaaaccaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 114 - protein, 372 aa, Zea mays
  G3680 polypeptide  Orthologous to G2999
MEAMDVKYKPVMFPNGAGLKKPKPAAAVALAGEPLYRECLKNHAASLGGHAVDGCGEFMPSPGANPADPTSLKCAACGCHRNFHRRTLEGSPPPPAPAPLALPPPPSVMHGQPHRAREETPEDRHPGVVDADDSDSDSEGSEYDEERSVSPPPPPHHLLPAPVAQQPPPPSYFPTAPHMVLSLGSGVPGPAVAVSPAQRLAPTQLTPSSAPPHAGGAMPMPRKRFRTKFTAEQKQRMQELSERLGWRLQKRDEAIVDEWCRDIGVGKGVFKVWMHNNKHNFLGGHSARRSASSPAPAPAAASLQTPAAGAGAGAAAAPSFNPSRITPPPPVLTSSPTAATGFNINGAASSAPTVATDYTTDNANGASSPHSA

SEQ ID NO: 115 - DNA, 990 bp, Oryza sativa (japonica cultivar-group)
  G3683 Predicted polypeptide sequence is orthologous to G2999
atggatctttctggggcgcagggcgagctgccgttgccaatgcacgccgcggcgtcgccgtacctcggcttgcaccatgaccaccaccaccatcatggcggcggcggcggcggtggagggatgaatgggcggcacatgtcgccgccgacgccaccggcggcggcggaggagtcgaaggcggtggtggtggtgtcgtcgtcggcgacggcggcggcgaggtacagggagtgcctcaagaaccacgcggcggccatcggcggcagcgccacggacgggtgcggcgagttcatgcccggcggcgaggaaggctcgctcgacgcgctccgctgctccgcctgcggctgccaccgcaacttccaccgcaaggagctcgacgccgccgccgccccgccgctccaccaccaccaccaccaactgctcggcgtcggcgcgcacccccgcggccacggccaccaccaccaccacctcctggtggcggcgctgccgccgccgacgcggatggtgatgccgctgagcgccatgcacacgtcggagtcggacgacgccgcggcgcgccccggcggcggcgcggcggcgaggaagcggttccggaccaagttcacggcggagcagaaggcgcggatgctggggttcgccgaggaggtcgggtggcggctgcagaagctggaggacgccgtcgtgcagcgcttctgccaggaggtcggcgtcaagcgccgcgtcctcaaggtctggatgcacaacaacaagcacaccctcgcccgccgccacctccacccctcccccgccgccgccgccggagacgacgacgacgacggcgcgccgccgccgcaccccgacccccggcggcgcgagctcgccgccgccgccgcaccacctccggctccagtaacccaacacatcaagaaatccgttgacaacaaaagcctcatttctagcttagctgcattgcattgcattgctctactactgttccatcaaattgatgcttaa

SEQ ID NO: 116 - protein, 329 aa, Oryza sativa (japonica cultivar-group)
  G3683 polypeptide  Orthologous to G2999
MDLSGAQGELPLPMHAAASPYLGLHHDHHHHHGGGGGGGGMNGRHMSPPTPPAAAEESKAVVVVSSSATAAARYRECLKNHAAAIGGSATDGCGEFMPGGEEGSLDALRCSACGCHRNFHRKELDAAAAPPLHHHHHQLLGVGAHPRGHGHHHHHLLVAALPPPTRMVMPLSAMHTSESDDAAARPGGGAAARKRFRTKFTAEQKARMLGFAEEVGWRLQKLEDAVVQRFCQEVGVKRRVLKVWMHNNKHTLARRHLHPSPAAAAGDDDDDGAPPPHPDPRRRELAAAAAPPPAPVTQHIKKSVDNKSLISSLAALHCIALLLFHQIDA

SEQ ID NO: 117 - DNA, 1096 bp, Oryza sativa (japonica cultivar-group)
  G3685  Predicted polypeptide sequence is orthologous to G2999
taacccaaagccatccagcactttgcgaggtcgctttcgtttcgcctccttcgtcggccccggaccggaccggacagaggcatgtcctgatggaattcaggggccatgacgaacccgtcgacgagatgggagtcgcgtacggcaggacgccaccctcctcctcctcctcccccgccgcctccgcctccgcggggaacggcgccggcgcggcggaggtgaggtaccacgagtgcctgcgcaaccacgccgcggcgatgggcggccacgtcgtggacggatgcagggagttcatgccgatgccgggggacgccgccgacgccctcaagtgcgccgcctgcggctgccaccgcagcttccaccgcaaggacgacgggcagcagcagcagcagctgcgcctgctcatcccgtccccgcccacgccgcgcgtcccgctgctcatgccgccgccgcagccgcagccgcacccgcacccgcaacacccctacctgcacccgccgttcccgtaccaccacaccccaagcggcagcggcggcacgacgaccgagtcgtccagcgaggagcgggggcctccctcctcgtcggcggcggcggcgcaggggcggcggaagcggttccggaccaagttcacgccggagcagaaggagcagatgctggcgttcgcggagcgggtggggtggcggatgcagaagcaggacgaggcactcgtcgaacagttctgcgcgcaggtcggcgtgcggcgccaggtgttcaaggtgtggatgcacaacaacaagagcagcatcggcagcagcagcggcggcggcagtaggaggcagccgcaggagcaacagtcacaacagcagcagcagcagcagtagccatgggaggagacaagcatttggttaatggtttggtaaatccccacctcattatttttatacgcccaagacatgaggagacgggttaaacaacgcaacggaagtgaggactactctctctgcgatctttatcctctctctctctctctctctctcttcatttggccttaaccttcattctttgtagtcacttatcctcctccataatttggttcttgattctagccttgtccaatttg

SEQ ID NO: 118 - protein, 255 aa, Oryza sativa (japonica cultivar-group)
  G3685 polypeptide  Orthologous to G2999
MEFRGHDEPVDEMGVAYGRTPPSSSSSPAASASAGNGAGAAEVRYHECLRNHAAAMGGHVVDGCREFMPMPGDAADALKCAACGCHRSFHRKDDGQQQQQLRLLIPSPPTPRVPLLMPPPQPQPHPHPQHPYLHPPFPYHHTPSGSGGTTTESSSEERGPPSSSAAAAQGRRKRFRTKFTPEQKEQMLAFAERVGWRMQKQDEALVEQFCAQVGVRRQVFKVWMHNNKSSIGSSSGGGSRRQPQEQQSQQQQQQQ

SEQ ID NO: 119 - DNA, 699 bp, Oryza sativa (indica cultivar-group)
  G3686  Predicted polypeptide sequence is orthologous to G2999
atggagctcagcgagcacgaggaggacgccggcgacgtgggcggtggctgctcatccccgcccacgccgcctcaccgcgtgctgacgtcggccgcccccgagacgatcaggtgccggtaccacgagtgcctccggaaccacgcggcggcctcgggcggccacgtcgtggatggctgcggcgagttcatgccggcgtccaccgaggagccgctcgcctgcgcggcctgcggctgccaccgcagcttccaccgccgggacccttccccgggccgcgcgggcgcagcacggctgctgcagctgcacctgccggcgtccatcaactcgcgcgcaccacccgcgctgctgctgccgcctgcagcggccgccagcaagcaaggtttgccgttccctggctacggcacgcccagcggcggcactggcaccacgaccgcgtcctccagcgacgagcggctgcggccctcgccggtgcagccacggaggcggtcacgcacgacgttcacgcgggagcagaaggagcagatgctggcgttcgcggagcgcgtggggtggaggatccagcggcaggaggaggcgacggtggagcacttctgcgcgcaggtcggcgtccggaggcaagcgctcaaggtgtggatgcacaacaacaagcatagcttcaagcagaaacagcagcaggagaacaggcaggaacagcagcagtag

SEQ ID NO: 120 - protein, 232 aa, Oryza sativa (indica cultivar-group)
  G3686 polypeptide  Orthologous to G2999
MELSEHEEDAGDVGGGCSSPPTPPHRVLTSAAPETIRCRYHECLRNHAAASGGHVVDGCGEFMPASTEEPLACAACGCHRSFHRRDPSPGRAGAARLLQLHLPASINSRAPPALLLPPAAAASKQGLPFPGYGTPSGGTGTTTASSSDERLRPSPVQPRRRSRTTFTREQKEQMLAFAERVGWRIQRQEEATVEHFCAQVGVRRQALKVWMHNNKHSFKQKQQQENRQEQQQ

SEQ ID NO: 121 - DNA, 1284 bp, Oryza sativa (japonica cultivar-group)
  G3690 Predicted polypeptide sequence is orthologous to G2999
atggagtacaagagatcatcgcatgtggaggaggaggaagaggaggaagaagaggaggacgacgaggaggaagacgaggaggagcaaggtcaccatcagtacacgacggcggcggcgcagcagcagctgcacccgcaggttcttggctcgtcggcttcctcgccgtcgtcgttgatggactccgccgctttctcgaggcccctcctgcctcccaacctgtcgctcgtgtcgccgtcggcggcggcggcggcggcgcccggtggatcctacctgcatgcggctcaccaccatgggcagggaagaagggtggaggcgcctggtggggagagccagcaccatctccagcgccatcatgagccggcgagaaatggcgttcttggcggcgtcgccggtgctcacgcggcgtctacgcttgccctcgtgggtggtggtggtggtggtccgagaggcggcgagggggcggcgggcgaggcgccgacgtggaggtacagggagtgcctcaagaaccacgcggcgcggatgggcgcgcacgtgctcgacggctgcggcgagttcatgtcgtcccctggcgacggcgccgcggcgctggcctgcgccgcgtgcggctgccaccgtagcttccaccgccgcgagccggcggtcgtcgcgccggcctcgctctcgctctgccccgcctccgcctccgcctccgccgccgccggcctggtgtccctatccccctccgcgacgcccaccggcgccaactcctcccggctcatgccgctcctcctcgccccgccgcacatgcagaagcgcccgcccgtcctccccgtgtccccggcgtctgcgcccgccgcgctggccgagtcgtcaagcgaggagctgcgcccgccgccgctcccctcttcccacccccacgcgcacgcggccgccgtggtggcggcgtcggcctccgcgccgccggggccgagcaagaagcgcttccggaccaagttcacggcggagcagaaggagcggatgcgtgaattcgcgcaccgcgtcgggtggcgcatccacaagcccgacgccgccgccgtcgacgcgttctgcgcccaggtcggcgtctcccgccgcgtcctcaaggtgtggatgcacaacaacaaacacctcgccaagacgcccccgtcgccgacatcgcagccgccgccgccgccgctccaccacgatccttctcctcctccccctcctcaccaccaccaccaccaccatcaccaccaccacccaccacaacaccatcagcagcagcagcagcagcatgatgcatga

SEQ ID NO: 122 - protein, 427 aa, Oryza sativa (japonica cultivar-group)
  G3690 polypeptide  Orthologous to G2999
MEYKRSSHVEEEEEEEEEEDDEEEDEEEQGHHQYTTAAAQQQLHPQVLGSSASSPSSLMDSAAFSRPLLPPNLSLVSPSAAAAAAPGGSYLHAAHHHGQGRRVEAPGGESQHHLQRHHEPARNGVLGGVAGAHAASTLALVGGGGGGPRGGEGAAGEAPTWRYRECLKNHAARMGAHVLDGCGEFMSSPGDGAAALACAACGCHRSFHRREPAVVAPASLSLCPASASASAAAGLVSLSPSATPTGANSSRLMPLLLAPPHMQKRPPVLPVSPASAPAALAESSSEELRPPPLPSSHPHAHAAAVVAASASAPPGPSKKRFRTKFTAEQKERMREFAHRVGWRIHKPDAAAVDAFCAQVGVSRRVLKVWMHNNKHLAKTPPSPTSQPPPPPLHHDPSPPPPPHHHHHHHHHHHPPQHHQQQQQQHDA

SEQ ID NO: 123 - DNA, 717 bp, Oryza sativa (japonica cultivar-group)
  G3692 Predicted polypeptide sequence is orthologous to G2999
atggagcagcagcaggagcggccgcgggaggtgtacagggagtgcatgcgcaaccacgcggcgaagctggggacctacgcgaacgacggctgctgcgagtacacccccgacgacggccacccggcgggcctgctctgcgcggcgtgcggctgccaccgcaacttccaccggaaggacttcctcgacggccgcgccaccgccgccgccggaggggcgggaggcgccggcgtcggcgtcgcgccaatgctgccggcccccggtggaggcgggccgccgggatacatgcacatggcggcgatgggaggagcggtgggcggcggcggcggcgtcgacggcggcggcggctccggggggaggcggcggacgcggaccaagttcacggaggagcagaaggcgcggatgctgcggttcgcggagcggctcgggtggcggatgccgaagcgggagcccggccgcgcgcccggggacgacgaggtggcgcgcttctgccgggagatcggcgtcaaccggcaggtcttcaaggtgtggatgcacaaccacaaggccggcggcggcggcggcggcggcggcagcggcggccccggcgccggtggaggcgcccagacgtcgtcgtcgacgaccaggggcggcggcgacgtcggggtgggcttgtcgccggcgatgggcggcgacggcgaggacgacgaggaggtgagggggagcgagatgtgcatgtag

SEQ ID NO: 124 - protein, 238 aa, Oryza sativa (japonica cultivar-group)
  G3692 polypeptide  Orthologous to G2999
MEQQQERPREVYRECMRNHAAKLGTYANDGCCEYTPDDGHPAGLLCAACGCHRNFHRKDFLDGRATAAAGGAGGAGVGVAPMLPAPGGGGPPGYMHMAAMGGAVGGGGGVDGGGGSGGRRRTRTKFTEEQKARMLRFAERLGWRMPKREPGRAPGDDEVARFCREIGVNRQVFKVWMHNHKAGGGGGGGGSGGPGAGGGAQTSSSTTRGGGDVGVGLSPAMGGDGEDDEEVRGSEMCM

SEQ ID NO: 125 - DNA, 765 bp, Oryza sativa (japonica cultivar-group)
  G3694 Predicted polypeptide sequence is orthologous to G2999
atgggcgcgcacgtgctcgacggctgcggcgagttcatgtcgtcccctggcgacggcgccgcggcgctggcctgcgccgcgtgcggctgccaccgtagcttccaccgccgcgagccggcggtcgtcgcgccggcctcgctctcgctctgccccgcctccgcctccgcctccgccgccgccggcctggtgtccctatccccctccgcgacgcccaccggcgccaactcctcccggctcatgccgctcctcctcgccccgccgcacatgcagaagcgcccgcccgtcctccccgtgtccccggcgtctgcgcccgccgcgctggccgagtcgtcaagcgaggagctgcgcccgccgccgctcccctcttcccacccccacgcgcacgcggccgccgtggtggcggcgtcggcctccgcgccgccggggccgagcaagaagcgcttccggaccaagttcacggcggagcagaaggagcggatgcgtgaattcgcgcaccgcgtcgggtggcgcatccacaagcccgacgccgccgccgtcgacgcgttctgcgcccaggtcggcgtctcccgccgcgtcctcaaggtgtggatgcacaacaacaaactcctcgccaagacgcccccgtcgcagacatggcagccgccgccgccgccgctccaccacgatccttctcctcctccccctcctcaccaccaccaccaccaccatcaccaccaccacccaccacaacaccatcagcagcagcagcagcagcatgatgcatga

SEQ ID NO: 126 - protein, 254 aa, Oryza sativa (japonica cultivar-group)
  G3694 polypeptide  Orthologous to G2999
MGAHVLDGCGEFMSSPGDGAAALACAACGCHRSFHRREPAVVAPASLSLCPASASASAAAGLVSLSPSATPTGANSSRLMPLLLAPPHMQKRPPVLPVSPASAPAALAESSSEELRPPPLPSSHPHAHAAAVVAASASAPPGPSKKRFRTKFTAEQKERMREFAHRVGWRIHKPDAAAVDAFCAQVGVSRRVLKVWMHNNKLLAKTPPSQTWQPPPPPLHHDPSPPPPPHHHHHHHHHHHPPQHHQQQQQQHDA

SEQ ID NO: 127 - DNA, 855 bp, Oryza sativa (japonica cultivar-group)
  G3695  Predicted polypeptide sequence is orthologous to G2999
atgatggatcacctgagcctggtgccctacgagggcggcagcgccggcgggggaggaggtggagggaagtacaaggagtgcatgcggaaccacgcggcggcgatgggcgggcaggcgttcgacgggtgcggggagtacatgccggcgtcgcccgactcgctcaagtgcgccgcgtgcggctgccaccgcagcttccaccgccgcgccgccgcgggcatcggcggcgggccggtgttcttccgcccgccgccaccgccgcagccgcactcgcaccacgccgcgctgcagggcttcctcccgtcgtccgtgccggcgccggcgccgccgccgcagctcgcgctgccgtaccacgccgtgcccgccgcggcgtggcaccacgcggcggcggcggcggcaggccgcgccggctcggagacgcccccgcggatggacgacttcggccccggcagcgccggcgggagcgggagcggcggcggcggcatcttcgggcggaagcggttccggaccaagttcacgccggagcagaaggagcggatgcgggagttcgccgagaagcaagggtggcgcatcaaccgcaacgacgacggcgccctggaccgcttctgcgtcgagatcggcgtcaagcgccacgtcctcaaggtctggatgcacaaccacaagaaccagctcgcctcctccccgacctccgccgccgccgccgccgccggcgtcatgaaccccggcgccggcatcggcctcggcaccggcctcggcaccggcatcagcggcgacggcgacggcgacgacgacgacaccgacgactccccgccccgcgccgccgtgtcctccccctccccttcaccgatcagcgtctag

SEQ ID NO: 128 - protein, 284 aa, Oryza sativa (japonica cultivar-group)
  G3695 polypeptide  Orthologous to G2999
MMDHLSLVPYEGGSAGGGGGGGKYKECMRNHAAAMGGQAFDGCGEYMPASPDSLKCAACGCHRSFHRRAAAGIGGGPVFFRPPPPPQPHSHHAALQGFLPSSVPAPAPPPQLALPYHAVPAAAWHHAAAAAAGRAGSETPPRMDDFGPGSAGGSGSGGGGIFGRKRFRTKFTPEQKERMREFAEKQGWRINRNDDGALDRFCVEIGVKRHVLKVWMHNHKNQLASSPTSAAAAAAGVMNPGAGIGLGTGLGTGISGDGDGDDDDTDDSPPRAAVSSPSPSPISV

SEQ ID NO: 129 - DNA, 999 bp, Zea mays
  G3719 Predicted polypeptide sequence is orthologous to G1274
ctgccggcgcgtgcgtctacttactcaggcggcctcgctaggactcgcccacgagacgagctacgccgcctactacccgccgcccgcgcccgcctcctcgtacttcccaccaccacccgacctcgtggcggacctcccgccgcccgccgccgccaccatggccgatgactacttccagttcgggttcaccggccaggagatggtggccgatgactgctcggcgccggtgttcgccaacagttcttcagacgccgtcaccgccgccgtcggcaatggcatgagcctgctgagctacggcgtggacggcgacggcgacgggaggaggccgatgagcggaccaccatatggcaccggtgggaacggcggcggccggccgccgtcgtcgtcacggatcgggttccggacgcggtcggaggtggacgtgctggacgatggcttcaagtggcgcaagtacggcaagaaggcggtcaagagcagccccaacccgaggaactactaccggtgctcgacggagggctccggcgtgaagaagcgcgtggagcgggacagcgacgacccgcgctacgtcgtcaccacctacgacggcgtccacaaccacgccgcgccgggcccgggcgccgcctcctacctgtgccaaccaccgccgccgcgcggcgcaaccgcgaccgcaacgcccttctcgcctccacgctcggcctcggcgccagcgcctctggctgcagcgcccagctggagcgccgcctgtgacgcgtggtgggaggcgcagctgcacgccgcggcggcggttgctcattcctcggagtcgtcgtactgatccgatccgtcatccatcagttattacacgcacgtacgggtcacgtagctagaatgtgttggaactctaaaacgctcacaagcacaggacacagattggtgagaggaggaagacgaatgaacagtagctaaacccaaagagttgggcgcccaaacacctgcagcgctccgaccctgcctttctct

SEQ ID NO: 130 - protein, 218 aa, Zea mays
  G3719 polypeptide  Orthologous to G1274
MADDYFQFGFTGQEMVADDCSAPVFANSSSDAVTAAVGNGMSLLSYGVDGDGDGRRPMSGPPYGTGGNGGGRPPSSSRIGFRTRSEVDVLDDGFKWRKYGKKAVKSSPNPRNYYRCSTEGSGVKKRVERDSDDPRYVVTTYDGVHNHAAPGPGAASYLCQPPPPRGATATATPFSPPRSASAPAPLAAAPSWSAACDAWWEAQLHAAAAVAHSSESSY

SEQ ID NO: 131 - DNA, 666 bp, Zea mays
  G3720  Predicted polypeptide sequence is orthologous to G1274
atggcggcagtcggagctcacccagtgctgtaccaccacccggcgccggcgggcgacgcctcctccatgtcctcctacttctcccacggaggcagctccaccacctccagctctgcgtccagcttcaccgccgcgctcgcgccgacgacgacggcgctcgccgagcatttcgacatctccgagttcctcttcgacgacgctgcgggcgctggggtcgccggcgcgccaggtgtgttcgccgatggcgcggcccgccccgtcgtcctgccggtgccggatgccgctggtggtggtgcaattatcggcgcagccgctgggggcgcggctgcggcgtcggaggtgccagagcggccgcggacgacgcggatcgcgttccggacgaggtcggagatcgagatcctggacgacggctacaagtggaggaagtacggcaagaagtccgtcaagaacagccccaacccaaggaactactaccggtgctcgacggaagggtgcaacgtgaagaagcgggtggagcgggacaaggacgaccccagctacgtggtgacgacgtacgaggggatgcacaaccacgtcagccccagtacggtgtactacgccagccaggacgccgcctccggccgcttcttcgtcgccggcacgcagccaccgggctccctcaactga

SEQ ID NO: 132 - protein, 221 aa, Zea mays
  G3720 polypeptide  Orthologous to G1274
MAAVGAHPVLYHHPAPAGDASSMSSYFSHGGSSTTSSSASSFTAALAPTTTALAEHFDISEFLFDDAAGAGVAGAPGVFADGAARPVVLPVPDAAGGGAIIGAAAGGAAAASEVPERPRTTRIAFRTRSEIEILDDGYKWRKYGKKSVKNSPNPRNYYRCSTEGCNVKKRVERDKDDPSYVVTTYEGMHNHVSPSTVYYASQDAASGRFFVAGTQPPGSLN

SEQ ID NO: 133 - DNA, 825 bp, Oryza sativa (japonica cultivar-group)
  G3721  Predicted polypeptide sequence is orthologous to G1274
agtggatcccccgggctggaggaaaattcaccggtgaaaaggttcagcactgtgcaatggcggcttccgtaggactgaaccctgaagctttcttcttcagcaactcctactcctactcctcatcccctttcatggccagctacacgccggagttctcggccgccgctatcgacgccaacttattctccggcgagctcgatttcgactgctctctcccagctccggcccaggagtacccggaaaatgaaaacactatgatgaggtacgagagcgaggagaagatgagggcgagggtgaacgggaggatcgggttcaggacgaggtcggaggtggagattcttgatgatggcttcaagtggaggaagtacggcaagaaagctgtcaagaacagcccaaatccaagaaactactaccggtgctcgacggaggggtgcaacgtgaagaagcgagtggagagagaccgggaggaccaccgctacgtcatcaccacctacgacggcgtccacaaccacgcgagccccgccgccgccgccgcggcgctgcagtacgccgccgccgccggcgactactacagcccgccgctcagcagcgccggctcgccgccggccgcctatttcggcaggcggcttcgctgctcttctgagggctgatgaagtttgtctaggactagacacgcccgggagctctagctaggatagaaaactagagaaagtttaattatacctgaattttaattaatcacctcacaaaactctgatgtatcatattatatcgtgatagtgactggttgttaatttaattttggcgatcgatgtgatcttcggt

SEQ ID NO: 134 - protein, 197 aa, Oryza sativa (japonica cultivar-group)
  G3721 polypeptide  Orthologous to G1274
MAASVGLNPEAFFFSNSYSYSSSPFMASYTPEFSAAAIDANLFSGELDFDCSLPAPAQEYPENENTMMRYESEEKMRARVNGRIGFRTRSEVEILDDGFKWRKYGKKAVKNSPNPRNYYRCSTEGCNVKKRVERDREDHRYVITTYDGVHNHASPAAAAAALQYAAAAGDYYSPPLSSAGSPPAAYFGRRLRCSSEG

SEQ ID NO: 135 - DNA, 834 bp, Zea mays
  G3722  Predicted polypeptide sequence is orthologous to G1274
cattgggtacctcgaggccggccgggaagttacttgcagctggccatgcacatggcgctatcgtcccgcagctcattcgccgccgacgtcctcctcccagccaccatgtcgtatcgtcagccgtgcagcggtgcttccagctacttgggctctcagcccgcggcccctttcccgtcggcagcgttcggcgcggtggcgcagctggacgtcttcgactgcctgtcgtcggacgaaggcgttggcgtcccggcagctgtacctggtgcgttcgcgccgccgccgccgcttatgccggccgagcgcgtcgtcccggacgctgctgcaggctacagtagtcatactaggagtgcagcggctgtggcgggtgaggggtcgaggactacgcacagaattgcgttccgagtgaggtcggacgaggacgaggtactcgacgacggctacaaatggaggaagtacggaaagaagtccgtcaagaacagccctaatccgaggaactactaccggtgctcgacggagggctgcaacgtcaagaaaagggtggagcgagacagggacgacccgagatacgttgtgaccatgtacgagggagtgcacaaccatgtgagtcctggtaccgtctattacgccacccacgacgccgcctccggccgcttcttcgtcgccgggatgcatcagccaggccattgatcaacgagcagatcagagagcgtcttaattagtgtaagatatgtataccgactatctgttttaggccttgttcatgttttaggtcttgtccagttattccaaatcatatagattggaatgtattgaaatgaattgagatagatttag

SEQ ID NO: 136 - protein, 213 aa, Zea mays
  G3722 polypeptide  Orthologous to G1274
MHMALSSRSSFAADVLLPATMSYRQPCSGASSYLGSQPAAPFPSAAFGAVAQLDVFDCLSSDEGVGVPAAVPGAFAPPPPLMPAERVVPDAAAGYSSHTRSAAAVAGEGSRTTHRIAFRVRSDEDEVLDDGYKWRKYGKKSVKNSPNPRNYYRCSTEGCNVKKRVERDRDDPRYVVTMYEGVHNHVSPGTVYYATHDAASGRFFVAGMHQPGH

SEQ ID NO: 137 - DNA, 1235 bp, Glycine max
  G3723  Predicted polypeptide sequence is orthologous to G1274
gtcttgacggtcccattttcaccccattgtgcaaattgaaagtagtagggaacccctactatagctactacatcatcacaatgacgtcaccttaacgtctctcgtgttgacacgtagctcagtgaggctatttcgctgcatcctccaagaaggtgtttggaaggatccttcccaccccatgccaaaagcaagcatattaattaaaaaaaatagaaaaaaataaaacacaattttattttattataggatatttattagttatttattggatataagtggcagcatgctttagtcctaggcgtgataaaaggccaaagactcttaggtttttggctctttgcagaatctttgagtgacacatacctagctatcacctcaatggattactattttggaaaccttaatcctaacccttattaccatcactctgccgtagtgaacatggcatctccctcctccgagttcatgttatctgattatctcgtgttggaagatgctcttgttgttgatcatcatcaagagtcttggtcacaaagcactgaaactgaatcatcggagaaagcaacctccagcgatgcaagtcatgggttcggtgatgcaacctccaccaacaccaacatgcatataaagtgccaaaatagtgggattaagggaaagaatgcagaagtgagtcaaaggatcacgtttagaaccagatcgcaacttgaggttatggatgatggatataaatggaggaaatacgggaagaaaacagtgaagagcagtcccaacccacggaactactacaagtgttcaggtgaaggatgcgatgtgaagaaaagggtggaaagggatagggatgactccaactatgtgttaacaacgtacgacggtgtccacaatcatcagaccccgtctactgcctactacagccaaatgcccttgctgcattctaatcatgattgggccctccacccttctgcaaactcataatatcctccttaatatagtaatatccagagataggagaatcaacttatacttttaggattactttttatctttattatttattttttataagagattttaaaaaataaataatgagaatagagaataattttaaaagaattattgttgatgtaagttaatctctactctgtatatatatatagttattgactcatttagtatattgcctgtcaataaccattattacatgtatattgattattatgcaggttcccctccacgct

SEQ ID NO: 138 - protein, 197 aa, Glycine max
  G3723 polypeptide  Orthologous to G1274
MDYYFGNLNPNPYYHHSAVVNMASPSSEFMLSDYLVLEDALVVDHHQESWSQSTETESSEKATSSDASHGFGDATSTNTNMHIKCQNSGIKGKNAEVSQRITFRTRSQLEVMDDGYKWRKYGKKTVKSSPNPRNYYKCSGEGCDVKKRVERDRDDSNYVLTTYDGVHNHQTPSTAYYSQMPLLHSNHDWALHPSANS

SEQ ID NO: 139 - DNA, 974 bp, Glycine max
  G3724  Predicted polypeptide sequence is orthologous to G1274
tcagaattctgctcgttgctctacgcaccatagtctttgttttcatttactaccatatttagttatcagcaatggacttctactttggaaactctcctccttatcccaataattatgctcataattctcttaatatggctctatcttcccctgagattgcactatccgattatctcatgctcgatgactatgttgatcatcaagattctcgatcatcacaaagcaccgagtcatctgaaaaagcaaccttcaatgatgccactcacggattcagtactggtgcaacctctaagaataataacataaactgcaaaaatgggattaatgaaaacaaaggtggagtgggtccaaggatcgcgtttagaaccaaatcagagcttgagatcatggatgatggatacaagtggaggaagtacggcaagaagtccgtgaagagcagtcccaatctaaggaactactacaaatgttcaagtggaggatgcagtgtgaagaaaagggtggaaagggatagagatgactacagctacgtgataacaacatatgaaggtgtgcacaatcatgagagcccatttaccacatactacagccccatctccttcgtacattctgatactactttcaaatgacaccaacttcaaacccttttgggcatttacacctccctagcttaattatgtgccaagaaaaagcttggaagattcgatcgagcaggggaagctatgtatcattgcattgtctaatcaatcataatttattttcatgctgtaataggttgaagagagtttctatacctttttttggttccacgtttaatatatctctcaattaaaaatcagcctttgctagttcatgtaacaaggaacatgattctccatgtgtaaagttgttcaaatcttaaaagtaagtatcttgtattaggattagagtatctctcttgtactctgtttaataataaaagttttgcctcctaaaaa

SEQ ID NO: 140 - protein, 184 aa, Glycine max
  G3724 polypeptide  Orthologous to G1274
MDFYFGNSPPYPNNYAHNSLNMALSSPEIALSDYLMLDDYVDHQDSRSSQSTESSEKATFNDATHGFSTGATSKNNNINCKNGINENKGGVGPRIAFRTKSELEIMDDGYKWRKYGKKSVKSSPNLRNYYKCSSGGCSVKKRVERDRDDYSYVITTYEGVHNHESPFTTYYSPISFVHSDTTFK

SEQ ID NO: 141 - DNA, 1369 bp, Oryza sativa (japonica cultivar-group)
  G3725  Predicted polypeptide sequence is orthologous to G1274
atgggcttcgccaaaacaacaaccgaaacggatatcaaattgtttcttatggggccgtgcggggcatcaaagcaaaacaattcgaaacggggcggctcgcgcacggtcgcgcgcgccgaagcttcatccaacgactcgagccaggaagctcgacggctcttcggcgcgtgtcacgtaagagagtcggccaacccacatgcacgtgtaccgatgtacatggcggcggcggctgcgggagcaagcacacccttcaatttttgccgccacggctcgcacgccgagtacgacgccgtcttcagcggcagctggatggcgcgccgcccctccgcggcgccgcacggtggcggcgcctccggctccggctccggcagcggctacggcgccgcctcgtacgttgctcccaccttcggcgcggcgtttaggcagcagcatctcgacctcctcgactacctgtccgacgatcagggcgttccggcgccaccaccagcggctgtgcccagcgcgtcgtacgtgacgccggcgccggcgatggcccccgctgaaccggtcgtgccggatgctgttgccgccgccggcggctatccgaggagcgtggctgcggcggcggcggccgtggccggcgagggaagagatcggacgacgacggacaagatcgcattccggacgaggtcggacgatgagatactcgacgacgggtataagtggaggaagtacgggaaaaagtccgttaagaacagccctaatccgaggaactactaccggtgctcgacggaggggtgcaacgtgaagaagagggtggagagagacaagaacgacccgcggtacgtggtgacgatgtacgaggggatccacaaccacgtgtgccccggcactgtctactacgccgcgcaggacgccgcctccggccgctttttcgtcgccgggatcagtcacccagaccttaattaagctaggatatgctttgccggcccagctgtggcttagcttgatgtgcagctctagttattgtatgggctgtacggttcagttatttgaagcgggttatacttatatgttgttaatgtttgcctactgattttaattaatttcttagagttagactcaatttggcggagggattcccttcaaaaaaagaaatcccttcaaaaaatttggcggagggacgactgatatatatggtgacattagctaggtttgctcacttttggcaaaaataacaagtttcctttcgtgccactctccgtccctaggtcagtgtttggcaaaacgcccaaaaaaatgtccgtgttgccaattaatttgtcgattgtgtacttcaatttcaagccaaatttcggcaaagctagtactttgtgtgttttagatgttg

SEQ ID NO: 142 - protein, 243 aa, Oryza sativa (japonica cultivar-group)
  G3725 polypeptide  Orthologous to G1274
MAAAAAGASTPFNFCRHGSHAEYDAVFSGSWMARRPSAAPHGGGASGSGSGSGYGAASYVAPTFGAAFRQQHLDLLDYLSDDQGVPAPPPAAVPSASYVTPAPAMAPAEPVVPDAVAAAGGYPRSVAAAAAAVAGEGRDRTTTDKIAFRTRSDDEILDDGYKWRKYGKKSVKNSPNPRNYYRCSTEGCNVKKRVERDKNDPRYVVTMYEGIHNHVCPGTVYYAAQDAASGRFFVAGISHPDLN

SEQ ID NO: 143 - DNA, 766 bp, Oryza sativa (japonica cultivar-group)
  G3726 Predicted polypeptide sequence is orthologous to G1274
gatttagcgccaatccttataaatacggagctttcgcgccggcctcgtactcggccatggcggcagtcggcgcgcacgcagcggtctaccaccacccggtctcgggcctctcggcgccggcgggcgacgccgcctactcgatgtcatcgtacttctcccacgggggaagctcgacctccagctccgcgtccagcttctccgccgccctcgccgccgcaacgacgccgccgcttcccgacccgtcggggtcgcagttcgacatctccgagttcttcttcgacgacgcgcctccggccgccgtgttcaatggcgcgcccaccgccgcgctgccggatggcgccgccgcaaacgcaacaaggagcgcggcggaggcggtgccggcgccggcgccggcggccgtggagaggccgcggacggagcggatcgcgttccggacgaagtcagagatcgagattcttgacgacggctacaagtggcgcaagtacggcaagaagtccgtcaagaacagccccaacccaaggaactactaccggtgctcgacggaagggtgcaacgtgaagaagagggtggagcgggacaaggacgacccgagctacgtggtgacgacgtacgaggggacgcacaaccacgtgagccccagcacggtgtactacgccagccaggacgccgcctccggccgcttcttcgtcgccggcacgcagccgccaggttctctcaattaaccgcgcgcgtacggttaatttgatcgatcgggtcagccatggga

SEQ ID NO: 144 - protein, 221 aa, Oryza sativa (japonica cultivar-group)
  G3726 polypeptide Orthologous to G1274
MAAVGAHAAVYHHPVSGLSAPAGDAAYSMSSYFSHGGSSTSSSASSFSAALAAATTPPLPDPSGSQFDISEFFFDDAPPAAVFNGAPTAALPDGAAANATRSAAEAVPAPAPAAVERPRTERIAFRTKSEIEILDDGYKWRKYGKKSVKNSPNPRNYYRCSTEGCNVKKRVERDKDDPSYVVTTYEGTHNHVSPSTVYYASQDAASGRFFVAGTQPPGSLN

SEQ ID NO: 145 - DNA, 1696 bp, Zea mays
  G3727 Predicted polypeptide sequence is orthologous to G1274
cggacggcacatcaacggacagacacacacaagcaaggcggctagcggtgcaagtagtgcgaagctagctaggtgctggtgcatgcaatggcggcttcgctgggtctgaaccctgaagctgtcttcacttcctacacctcctcgccgccgttcatgtcggactacgtggcggcgagcttcctgccgccggccgtcgtcgactccacggacttctctgcagagctcgatgatcttcaccaccacttggattactcatcgccggcgccgaccttggccggggctcggagcgatcgcagcgagaagcagatgatcaggtggtgtgagggtggtggtggcgagaagagactcggtaggatcgggttcagaacgagatcagaggtggagatcttggacgatggattcaaatggaggaagtatggcaagaaggctgtcaagagtagcccaaatccaaggaactactaccgctgctcgtcggagggctgcggcgtgaagaagcgggtggagagggaccgcgacgacccccgctacgtcatcaccacctacgacggcgtccacaaccacgcaagccccgcagccgccgccatcatccagtacggcggcggcggcggattctatagcccgccgcacagcggctcgccgtcggccgcctcctactcgggctccttcgtcctctgacttctccgggccttgacccagagtgatctgatctacctgctttatcccagtcgtaggatgagaagagtgttcagacttcagagacatcagttcagcggccggctaaattcggacctgattgtagatatttacacctcaattattggttacctcttgtgacgactgacgaggcatcataatcgtcactaggataattgatcacgcatgtttttcgcttaattagtttctgtgtatacatacgaagtttgccgtatagctgataggctgctgatttaacttgacttctctttgttcggtattagaccccaagatcaacatttacgctgaacagatgctttgtaacagtgaaggaatattttatggtttttccagatatatgccattatgaaaataaaaaaaaaaaaaaaaaaagcggccgcttggtttgtctctttgttggcattccttgcaacaaattattaattctccacggtacagaacgggacatcatcacaatgtcagtgcgcaaccataactgaactgcaacaatgaagaacaggtagcaaaccttatttcgagcaaacagtcagctcagcttagaaactaactaaaaagagcacggcactcattggcctcattagccatctcttccatgctcctatctttcctctcaatgtccaggtcaagcttctccttcaattctttctccttcacatcaatcgcatcatatatttcatcatttttctcaaaatcccctttcttccttgggatgaggtggatgtggacatgcgcaactgtttggccagcttgaggaccatcctggatagcaaaggtaagtgacgatgctttgtggtactgctcaagacgtgcaccaacttcctttgcagtaacccataagtcactaatctcatcagaacttagatcggcgaatcttttcacttcacgcttggggcacacaagaacatgtaggtattgtcaaggaaaaaccagtgcatatagaagaacacagtttcctaaaacatgatgtatcaaactttgagtc

SEQ ID NO: 146 - protein, 195 aa, Zea mays
  G3727 polypeptide  Orthologous to G1274
MAASLGLNPEAVFTSYTSSPPFMSDYVAASFLPPAVVDSTDFSAELDDLHHHLDYSSPAPTLAGARSDRSEKQMIRWCEGGGGEKRLGRIGFRTRSEVEILDDGFKWRKYGKKAVKSSPNPRNYYRCSSEGCGVKKRVERDRDDPRYVITTYDGVHNHASPAAAAIIQYGGGGGFYSPPHSGSPSAASYSGSFVL

SEQ ID NO: 147 - DNA, 1663 bp, Zea mays
  G3728 Predicted polypeptide sequence is orthologous to G1274
cattgggaccctcgaggccggccgggtctaattatatgataggtgtcaagtggaagtgcagtgatgtatgcagctgaggcatcctaacagaccccggccgacgggaaacaagaaagaaaaaatcgagaggacgccagggccgattctctgcgtgacttggggcgtcgtcgccgagttttctccggccgagggcggcgcgaccggacaaccagcgtgagcgcgaccggcgacatgactcgcggcaaccagcgtgaccgcgaccgtgagcgcgcggcggcgcggaagcccaacgccaagaactcccaggacgggctcaccccggagcagcgccgcgagagggacaagaaagctctggaggagaaggcggccaagaaggcgcagcaggcagcggccggcggcaccgggacctccacggacaacaacaagaacaaggcaggtggcaagaagtaggaggcagtggcgcgccgccacctctgtacgattaatcgatgccttgagcttgtaacttgttcgcatccttgtaggtgcgatgcttgttgggtcataaactctgatgatatcgagatttggtgatcagaaataatgcgtggttttcgcgcccaaaattgggaaccccgaggccggccggggttattcaggcaggcgcattgactgatacacatatatacaacaagcaaggcggctagctacagcggctagtgcgcgcgtggtgcaggcgcatctagctactacctggtgcttgttgtgcatacaatggcgacttcgctgggactgaaccctgaagatctcttcacttcgtactcgtcttcctactactcctcgccgccgttcatgtccgactacgcggcgagcttcacgccggcggccggggactccacggccttctcctcggagctcgacgaccttcaccacttcgactactcaccggcgccgatcgtcactgctgccggagccggggctgggggcggcgatcgcaacgagaagatgatgtggtgtgagggtggtggtgacgagagaagactcagaagcaacggaaggatcgggttcagaacgaggtcagaggtggagatcttggacgacggattcaagtggaggaagtacgggaagaaggccgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagccccggagccgctgctatcatcgtcccgtacggcagcggcggcggcaatagcggcttctacagcccgccgcacagcggctccccgtcggccacctcctactcgggctccctagccttctgacttttccgggccttgacccatagttacctttacactccagtcgtcggataagaagaatgttcagcggctggctaaacagtctcaactgctgcagctattcaaattagtgttggagatgcaatttatagagataaaatactctagaagctatcgctgtagccggattaaattctgacctacttgtatagttttacacttacacagtgcaagtaataatatttaagggaagcagagagcactctaggcggccgctcaaaaaaaaaaaaaaaaaaaaaaaaaaaaaaaaaaaaag

SEQ ID NO: 148 - protein, 205 aa, Zea mays
  G3728 polypeptide  Orthologous to G1274
MATSLGLNPEDLFTSYSSSYYSSPPFMSDYAASFTPAAGDSTAFSSELDDLHHFDYSPAPIVTAAGAGAGGGDRNEKMMWCEGGGDERRLRSNGRIGFRTRSEVEILDDGFKWRKYGKKAVKNSPNPRNYYRCSSEGCGVKKRVERDRDDPRYVITTYDGVHNHASPGAAAIIVPYGSGGGNSGFYSPPHSGSPSATSYSGSLAF

SEQ ID NO: 149 - DNA, 1091 bp, Oryza sativa (japonica cultivar-group)
  G3729 Predicted polypeptide sequence is orthologous to G1274
aaagcgctctgcgtgagctgagctgagctaggcgtcgcgcgcgatgtcgtcgctgtacccgtctctcctctcgctgagcgagagccccgccgagtaccggcaggtcggcggtggccgctacgcgggggaggacgtcgtcgacgacgacgacgacatggctgccgtcgccgacgctgtgtccagctacctctccttcgacatggacgacgtcgagtattacacgccggaggtgggcttccactcaaagcagcacaacccgccgccagttgctgcggcgccactggaagccggaggaggcagggagcaaagccggcgggaagccgccgtcaatcttggcaagatggacaggggaccggcgccggtgagcggcggcgcggcgactggcggcgtgccgaggagcaagaacggcagcaagatcgcgttcaagacgaggtcggaggtggacgtgctggacgacggctaccggtggaggaagtacggcaagaagatggtcaagaacagccccaacccaaggaactactaccggtgctcgagcgaggggtgccgcgtgaagaagcgggtggagcgcgcccgggacgacgcgcgcttcgtcgtcaccacctacgacggcgtccacaaccacccggcgccgctgcacctcaggccgcagctgccgccgcccggcggctactcgatcgccggggcaccggccgtggtggcgccgcacggccgcctcgggctggaggaggccgaggtgatcgctctcttcaggggcaccaccgccacctcgctgctgcttccttgaccggccagtccgacgcggcggcgccggcggcgacaactgactagctagtgtgagtcctgggccgtacaggaatggacaattagtttgtctccgatcgaggaccaaggcgacctgaatcaaaattacggcccatcgatatatagtaggtcgtttaattcatcgaaattagacgaatttcatgtacaattattgcattacagtattatttgaaacagtattgtatatatttgctatacaatttgatggatcgtatgtctttagcagttgtaagtatattaatctatagatctagtagttcagccatgat

SEQ ID NO: 150 - protein, 246 aa, Oryza sativa (japonica cultivar-group)
  G3729 polypeptide  Orthologous to G1274
MSSLYPSLLSLSESPAEYRQVGGGRYAGEDVVDDDDDMAAVADAVSSYLSFDMDDVEYYTPEVGFHSKQHNPPPVAAAPLEAGGGREQSRREAAVNLGKMDRGPAPVSGGAATGGVPRSKNGSKIAFKTRSEVDVLDDGYRWRKYGKKMVKNSPNPRNYYRCSSEGCRVKKRVERARDDARFVVTTYDGVHNHPAPLHLRPQLPPPGGYSIAGAPAVVAPHGRLGLEEAEVIALFRGTTATSLLLP

SEQ ID NO: 151 - DNA, 850 bp, Oryza sativa (japonica cultivar-group)
  G3730 Predicted polypeptide sequence is orthologous to G1274
ctgtcaaacactcaatcagcagcagcagcagctagcttagcttagctaacgcacagtgacgcgagcatggcggcttcgctgggactctgccacgagacgtcgtacgcctactcgtacccggcgtcgaacacctcctcctccttgtgcttccctcctctcatggcggaccacatcgtcgacggcggcggcggcggcggctgttcctttggtgaattcctggagctcggccattccgtgtactcgctgccgcttccgccgccgccgtcgcagccggtggtggtcgccggcgggaacaatgatcagtatggcgtgtcgtcgtcgtcgtcggcggcggcgacgacgagcaggatcgggttcaggacgaggtcggaggtggaggtgctggacgacgggttcaagtggcgaaagtacgggaagaaggcggtgaagagcagcccgaacccgcggaactactaccggtgctcggcggcggggtgcggcgtcaagaagcgggtggagcgcgacggcgacgacccgcgctacgtcgtcaccacctacgacggcgtccacaaccacgcgacccccggctgcgtcggcggcggcggccacctcccgtaccctacttccgctgcgccgccgtggagcgttccggcggcggcggcctcgccgcctcccgcgcacgcgcaggcgtggggggcgccgctgcacgccgccgcggcggcgcactcgtcggaatcgtcgttctgaacgctgaatttacttctgtttttgtttttcttggttgcttgttagttgtaccgccgttcgtgatcgatcgatcggttcttgtatgcactagacttactacttaaaaaaaaaaaagttaaatctt

SEQ ID NO: 152 - protein, 219 aa, Oryza sativa (japonica cultivar-group)
  G3730 polypeptide  Orthologous to G1274
MAASLGLCHETSYAYSYPASNTSSSLCFPPLMADHIVDGGGGGGCSFGEFLELGHSVYSLPLPPPPSQPVVVAGGNNDQYGVSSSSSAAATTSRIGFRTRSEVEVLDDGFKWRKYGKKAVKSSPNPRNYYRCSAAGCGVKKRVERDGDDPRYVVTTYDGVHNHATPGCVGGGGHLPYPTSAAPPWSVPAAAASPPPAHAQAWGAPLHAAAAAHSSESSF

SEQ ID NO: 153 - DNA, 708 bp, Lycopersicon esculentum
  G3731 Predicted polypeptide sequence is orthologous to G1274
cgttccgttcaactatggaaaattttccctatagctcatcaaaccctaaccctaattttatcgacgcatcggagaattttgagctctccgattataattatctttttctcgatgatggatcgagtgacgattttttgtcacaaaatgaaattgttcaaagtgtttccgatactagtggttcatattcaaataatcctactccaacaagtcataacataaaatgtatgaaaggtataaagaaggtggatgcaaagtctaaggttgcatttagatttagatcagagttggaggtgttggatgatggatttaaatgtaggaaatatggcaaaaagatggtcaagaataatccaaatccaaggaattactacaaatgttcaagtgggggatgcaatgtgaagaaaagagtagaaagggacaataaagattcaagctatgtcattactacttatgaagggattcacaaccacgagagtcctcatgtgcttcactacacacaattccctcccaacaatattgcccttcacaatcttcacctttagaacctcttaaacgtgtcagtaaagtttagttatatatttgtattatggtaggttctaatggagcactttgattatatgataaagtgtttttattgaacattttcgacatatgttttaaaaaagttgtgcacgaattttcaagtgctaaatatatagataagttaatcgc

SEQ ID NO: 154 - protein, 174 aa, Lycopersicon esculentum
  G3731 polypeptide  Orthologous to G1274
MENFPYSSSNPNPNFIDASENFELSDYNYLFLDDGSSDDFLSQNEIVQSVSDTSGSYSNNPTPTSHNIKCMKGIKKVDAKSKVAFRFRSELEVLDDGFKCRKYGKKMVKNNPNPRNYYKCSSGGCNVKKRVERDNKDSSYVITTYEGIHNHESPHVLHYTQFPPNNIALHNLHL

SEQ ID NO: 155 - DNA, 743 bp, Solanum tuberosum
  G3732 Predicted polypeptide sequence is orthologous to G1274
tttctatcttttctttcccttcaacaatggaaaattttccatatagctcatcaaaccctaaccctaatttcatcgatgcatcggagaattttgagctctcagattataattatctctttcttgatgatggatcaaatgacgattttttgtcacaaaatgaaattgttcaaagtgtttccgatagtagtggatcatattcaaataatcccactccaacaagtcataacataaaatgtatgaaaggtgtaaagaaggtggatgcaaagtctagggttgcatttagatttagatcagagttggaggtgttggatgatggatttaaatggaggaaatatggcaaaaagatggtcaagaatagttcaaatccaaggaattactacaaatgttcaagtggaggatgcaatgtgaagaaaagagtagaaagggacaatgaagattcaagctatgtcattactacttatgaagggattcacaaccatgagagtccttatgtgtttcactacacacaattccctcccaacaatattgcccttcacaatctttgcctttagaacctcttaaacgtgtcagtaaatttcagttatatatttgtataatggtaggttctaatagagcactttgatcatatgataaagtgtttctattaaacattttcgacttatgttttaaaaaaatgtgtgcacgtgttttcaagtgcccgatatatagataagttaatcacataaaatatgtctctttctttg

SEQ ID NO: 156 - protein, 174 aa, Solanum tuberosum
  G3732 polypeptide Orthologous to G1274
MENFPYSSSNPNPNFIDASENFELSDYNYLFLDDGSNDDFLSQNEIVQSVSDSSGSYSNNPTPTSHNIKCMKGVKKVDAKSRVAFRFRSELEVLDDGFKWRKYGKKMVKNSSNPRNYYKCSSGGCNVKKRVERDNEDSSYVITTYEGIHNHESPYVFHYTQFPPNNIALHNLCL

SEQ ID NO: 157 - DNA, 1387 bp, Hordeum vulgare
  G3733 Predicted polypeptide sequence is orthologous to G1274
gaattcggcaccagggcgctcaccatcgccgaagcttctcagcgcgaagctcaccgggaagccgaccaaaatcccccgggaaaaaaagagagctctcacggccggcgccatctccaactagtacaaatctacccgccaaatccactccccaacccaatccatgcagcagcagcagcagcagcgcaccggcgatttagggggtcttatatattataaataggaagcgctctcgccggtgacaaactcggtcatggcggcagtcggagcggcaccagtgctctaccaacagcaggcgcaggcggtgggcgacgcctgcttcttctcctccatgtcctcctacttctccaacgaggcaatcagctcctcctgctccagcccagcctccagcttctccgccgcgctgggcgccacgccgcccgctgcgccggcgatcagccccgaccccgcgtcgcagttcgacatctccgagtacctctacggcgacggcccgttagccgcgccgctggcgcccgttggcgctgctgttgcaagctcggcgactgcggtgcctgcgaggagcgcggccgagtcggcggcggcggtggagaggccgcggacggagcgcatcgcgttccgcacgaggacggagatcgagatcctcgacgacggctacaagtggcgcaagtacggcaagaagtccgtcaagaacagcccaaacccaaggaactactaccggtgctcgacggaagggtgcagcgtgaagaagcgggtggagcgggaccgggacgacccggcgtacgtggtgaccacgtacgagggcacgcacagccacgccagccccagcaccgtctactacgccagccaggacgccgcctccggccgcttcttcgtcgccggcacgcacccgccgccaggctccctcaactgagtagactagccaccaacgacggagcacgtcgagatcagcacgtacggggcttccatcttgggcaagctagccagctcgggcctcggtgccgtagcagccacaagttcgtagttaaactagtgcactactggttcaggttcggtttcccgactgtagtgttgtgtactgcggtgtgcactgtcggctcgatcaccaggttttatccctcgagcataattagtggatcgaaagagcccggccggggaacgtaactcagtccactactagtgctgcctacttaaccgtgtaataaaaatacccatgtgccgtttccctcagcccataggcctccgagagttccatgtttaagcaccaacatgcatcaaagagcatctaaaaaaagcatcaaagagatccatgtagaaaaagtttgtcgtattacccgacagaaaaaagtttgtagcatttttttggtaaataattttggaaggttttacagtt

SEQ ID NO: 158 - protein, 218 aa, Hordeum vulgare
  G3733 polypeptide  Orthologous to G1274
MAAVGAAPVLYQQQAQAVGDACFFSSMSSYFSNEAISSSCSSPASSFSAALGATPPAAPAISPDPASQFDISEYLYGDGPLAAPLAPVGAAVASSATAVPARSAAESAAAVERPRTERIAFRTRTEIEILDDGYKWRKYGKKSVKNSPNPRNYYRCSTEGCSVKKRVERDRDDPAYVVTTYEGTHSHASPSTVYYASQDAASGRFFVAGTHPPPGSLN

SEQ ID NO: 159 - DNA, 653 bp, Medicago truncatula
  misc_feature (605)..(605): n is a, c, g, or t
  misc_feature (610)..(610): n is a, c, g, or t
  misc_feature (615)..(615): n is a, c, g, or t
  misc_feature (625)..(625): n is a, c, g, or t
  misc_feature (647)..(647): n is a, c, g, or t
  misc_feature (652)..(652): n is a, c, g, or t
  G3735 Predicted polypeptide sequence is orthologous to G1792
ctaatccttcatactaaagaaaacatagacttataacaaaaatattattatttacttcgtatatttttgtgtttcaaattaatggagggagatcataaattagtttcaaattcaacaaatggaaatggaaatggaaatggaaattcagatcaaataaagtatagaggaattcgtagaagaccatggggaaaatttgcagcagaaattcgtgacccaacaaggaaagggacaagaatatggcttggaacatttgatactgctgaacaagctgcaagagcttatgatgctgctgcttttcattttcgtggtcatagagctattctcaatttccctaatgaatatcaagctcctaattcatcttcttcattacctatgcctcttactatgcctccaccaccttcttctaatccacctccttcttcttcttcttcttcctctttttcttcttacaccgttgatgatggttttgatgagcttgaattcttggataataagttgcttcaagaacttcttcaagatggaacacaatagttaactattgaagatcaagtggcatgaaatgtattggtggtcatttaattttctcttcattaatttattttggnttggntatgnatctcatttntatgaataaatgagaatggggnattana

SEQ ID NO: 160 - protein, 149 aa, Medicago truncatula
  G3735 polypeptide  Orthologous to G1792
MEGDHKLVSNSTNGNGNGNGNSDQIKYRGIRRRPWGKFAAEIRDPTRKGTRIWLGTFDTAEQAARAYDAAAFHFRGHRAILNFPNEYQAPNSSSSLPMPLTMPPPPSSNPPPSSSSSSSFSSYTVDDGFDELEFLDNKLLQELLQDGTQ

SEQ ID NO: 161 - DNA, 859 bp, Triticum aestivum
  G3736 Predicted polypeptide sequence is orthologous to G1792
gcacgaggcttcattctccctcgttccatccaagctccaccatccatcactgatttgcacttacctagctactccgcaacccccacttccggcttcttcatttctcactactagtacgtagttgagattatggagggcggagaaggatccggtggcggcggcgagccgaccaagtaccgcggggtgcgccgcaggccgtggggcaagttcgccgcggagatccgggactcgagccggcacggcgtgcgcatgtggctcggcaccttcgacaccgccgaggaggccgcggccgcctacgaccgctccgcctactccatgcgcggccgcaacgccgtgctcaacttccccgaccgggcgcacgtctacgaggccgaggccaggcgccagggccagggctcttcgtcgtcggcgaggcagcagaatcagcagcagcagcaggggcagagcggggtgatcgagttcgagtacctggacgacgacgtgctgcagtccatgctccacgaccacgacaaatccaacaagtagatcgatggatcatccatccatccatccatggatcgatccataatacctactgtatcatcccggcccggccggcaacatcgacctgcgtgcatgcgcgggcgcggatgcaatctacactacctacctatgcattccggccatatattaggtacgtagattatatgtgtacgagagcctacgagctcgatgaagatcgtacgtggtgcattctgatgcatgaggattccatcgacacgaccctctaccatatatttgatgggtcgatcgagtaatttgcagccagtaatccaatcgatgatatggggttttcaaaaaaaaaaaaaaaaaaaaaaaa

SEQ ID NO: 162 - protein, 131 aa, Triticum aestivum
  G3736 polypeptide  Orthologous to G1792
MEGGEGSGGGGEPTKYRGVRRRPWGKFAAEIRDSSRHGVRMWLGTFDTAEEAAAAYDRSAYSMRGRNAVLNFPDRAHVYEAEARRQGQGSSSSARQQNQQQQQGQSGVIEFEYLDDDVLQSMLHDHDKSNK

SEQ ID NO: 163 - DNA, 882 bp, Oryza sativa (japonica cultivar-group)
  G3737 Predicted polypeptide sequence is orthologous to G1792
acacatgcatcgatcattcatggatgccgaattgccgcgatccgggcattatttcgcgccaggagacccaagatcatcgtgtcgcccacgctataaatagctagctagcttgcctttatgttgcatatgccaactgctacatgcaggacgtctgaaactatcattagtgacctgcagcgcctgcagtatatatatacaagtagtagtgagcatggaggacgacaagaaggaggcggcgagcaagtaccgcggcgtacggaggcggccgtggggcaaattcgcggcggagatccgcgacccggagcgcggcggctcacgcgtctggcttggcacgttcgacaccgccgaggaggccgcgcgagcgtacgaccgcgccgcattcgccatgaagggcgctatggccgtgctcaacttcccaggcaggacgagcagcaccggctcttcgtcgtcatcgtcatccacgccgccagctccggtgacgacgagccgccactgcgccgacacgacggagaaggtggagcttgtgtaccttgacgacaaggtgctcgacgagctccttgcggaggactacagctaccgcaacaacaacaactactgatccggccgtcgatgaactgagacggatcgacatggggccggtcgtcggtacgctcgctgaaacgagacccggattgctatcaataagcaagcagaagaaaaccgtctcctatatatagcttcttctgttggcacaagcatatatgggcatgcatgacacatgctactgtgaattgacgggtgtgtgctgtgtgcagactactaaaccacgcttgcaagttgcacgtacgacgtggttgtcaagagcatgcagtccacgaagcagagaaaaacacctggtttatc

SEQ ID NO: 164 - protein, 128 aa, Oryza sativa (japonica cultivar-group)
  G3737 polypeptide Orthologous to G1792
MEDDKKEAASKYRGVRRRPWGKFAAEIRDPERGGSRVWLGTFDTAEEAARAYDRAAFAMKGAMAVLNFPGRTSSTGSSSSSSSTPPAPVTTSRHCADTTEKVELVYLDDKVLDELLAEDYSYRNNNNY

SEQ ID NO: 165 - DNA, 899 bp, Zea mays
  G3739 Predicted polypeptide sequence is orthologous to G1792
cgatataattcactcctctcaacgctcgctgcacacacacaccagtgaacctagccagccatttgccgcatcgatcatcagtcgctgtcacgcgcgccaaaccaaaccaaagcccaaacccagctgcaagtgctactgacagcagctagcaaacacacacccgtcgccatcgctatggacggcgactggtccaaggacggcggaggtggagagccgaccaaatatcgcggcgtgcggcggcggccctggggcaagtacgcggccgagatccgcgactcgagccgccacggcgtccgcatctggctgggcaccttcgacaccgccgaggaggccgccagggcgtacgaccggagcgcctactccatgcgcggcgccaacgccgtcctcaacttcccggaggacgcgcacgcctacgccgccgcctgccgcggctccggatcctcctcatcctcgtccaggcataggcagcagcagcagcagggctccggcagggacgtgatcgagctcgagtacctcgacgacgaggtgctgcaggagatgctcaggaaccacgagccgtcgtcgtctgcgaggaagaagatgtaatgcaagacgactggtacacgtggcgaatgcacgttgcacatcagaatgccatgtatgcgtggggggttacgttcaattgtatgcatgcagtgcagtgactaccggccggctctcctggatatgtcggccatctctctctatatattattaaaatgtcagctcccttctctaatttggcgggagttacatcagtggtactatgcagagttgcatacttgcatatatatgcacattattaattaataactcgatctctcgtggacggtggaacagtgataatcatctcattgtcaattaattttgatcaaagaaat

SEQ ID NO: 166 - protein, 136 aa, Zea mays
  G3739 polypeptide Orthologous to G1792
MDGDWSKDGGGGEPTKYRGVRRRPWGKYAAEIRDSSRHGVRIWLGTFDTAEEAARAYDRSAYSMRGANAVLNFPEDAHAYAAACRGSGSSSSSSRHRQQQQQGSGRDVIELEYLDDEVLQEMLRNHEPSSSARKKM

SEQ ID NO: 167 - DNA, 645 bp, Oryza sativa (japonica cultivar-group)
  G3740  Predicted polypeptide sequence is orthologous to G3086
atggccagcaacggctttccaggctcaaaaggcgggggaggcagcggagccgaagcccaccaccacccttccatggccggcagcggcagcggcagcagcagcggcgggaggaagatgaagtcccagctgagcttcacggccgggccgccgcacctctcgcacatcgcggaggacggcgccttccccgaccgcgccggcgccgaggcctccgtgccccgcaccttctccgccggcggcagcagcggcggcggcgggttctccatcgtcgggccgtgggaggagtccagggacatcatctccaccctcggcgggtacgagtcccagttcggcggcatggcgagcacgtcggcgctggagatggccggcatggacaggtacctgcagctgcagcatgaccaggtgccgttcaaagtgcgggccaagcgcggctgcgcgacgcaccccaggagcatcgcggagagggaacggaggacgagaattagcgagaagctcaggaagctgcaggagctggtgcccaacatggacaagcaaacaagcacagcggacatgttggaccttgcagttgagcacatcaagggtctgcagagccagctgcaggctctgaagcatgagcaggagaagtgcacttgctgcagcaggccttga

SEQ ID NO: 168 - protein, 214 aa, Oryza sativa (japonica cultivar-group)
  G3740 polypeptide Orthologous to G3086
MASNGFPGSKGGGGSGAEAHHHPSMAGSGSGSSSGGRKMKSQLSFTAGPPHLSHIAEDGAFPDRAGAEASVPRTFSAGGSSGGGGFSIVGPWEESRDIISTLGGYESQFGGMASTSALEMAGMDRYLQLQHDQVPFKVRAKRGCATHPRSIAERERRTRISEKLRKLQELVPNMDKQTSTADMLDLAVEHIKGLQSQLQALKHEQEKCTCCSRP

SEQ ID NO: 169 - DNA, 1110 bp, Oryza sativa (japonica cultivar-group)
  G3741 Predicted polypeptide sequence is orthologous to G3086
atgaacccggcgccgtcgagggcgccgcagcggcagcagcgcggaggggagatgtcggcgcgctacggcggcgggctgcagttcttcgctgacgccccgccggcgggggtggaggggggcgccgcgaccgcgcggacgttcttcccggtgccgggcgggggaggggagcagcagccgccggagcgcgcgatgaggcagcagcactacggcggcggcgggagtggtgcggccgagatctcgctggggcacggccacggccacggcggcaagcaccatttccatcagttcggcgtcgaggcgaaggacggtggcggcggcggcgaccagtcggggtttctgacgcggcacaacagctcgcctcccgggttcttctcgagccccgtcatggacaacggtttctcatcgagtgctagaccagcaggatcatcactcggtgaggttcgccatggcgccatgagcagcagcagcaacaacaacaagaagatgaaggccccactgagcttcgctagcagcaggcagggctccggcggcctctcccagatatccgaggacggcatcccggacctcactgacagcatccatggcgccgctcatcatcatgggcgctccgaggagaacgtctccacccacgaccacgtcgtccgctccttctcctccggtgggttctcgatcgggtcatgggaggactccaactccatcgtgttctccacgtcgacgggcaaatcaggagcgcacggcaacgacgacatcatcgccacccctagcaactacgaatctcagcttgttgcgcccagggagatggctggcgtagagaaatacctgcagatgcagcacgaccaggtgccattcagagtacgggccaagcgtggatgcgcgacgcacccacggagcatcgcagagagggagagaagaacgaggatcagcgagaagctcaggaagttgcaggccctggtgcccaacatggacaagcaaacgagtacttcagacatgctggacttagcagttgatcacatcaagggactgcagagccagctgcagactctgaaggaagacaaggagaaatgcacctgcagctgcaagcaagcatcaaggaacagaccagccgactaa

SEQ ID NO: 170 - protein, 369 aa, Oryza sativa (japonica cultivar-group)
  G3741 polypeptide  Orthologous to G3086
MNPAPSRAPQRQQRGGEMSARYGGGLQFFADAPPAGVEGGAATARTFFPVPGGGGEQQPPERAMRQQHYGGGGSGAAEISLGHGHGHGGKHHFHQFGVEAKDGGGGGDQSGFLTRHNSSPPGFFSSPVMDNGFSSSARPAGSSLGEVRHGAMSSSSNNNKKMKAPLSFASSRQGSGGLSQISEDGIPDLTDSIHGAAHHHGRSEENVSTHDHVVRSFSSGGFSIGSWEDSNSIVFSTSTGKSGAHGNDDIIATPSNYESQLVAPREMAGVEKYLQMQHDQVPFRVRAKRGCATHPRSIAERERRTRISEKLRKLQALVPNMDKQTSTSDMLDLAVDHIKGLQSQLQTLKEDKEKCTCSCKQASRNRPAD

SEQ ID NO: 171 - DNA, 837 bp, Oryza sativa (japonica cultivar-group)
  G3742 Predicted polypeptide sequence is orthologous to G3086
atggcttccgccatggcgggactctaccgcaccgtcagctccggcggcacggagtccaccgccgccgccgccggcaacagcctcctccggcagagcagctcccccgccggcttcctcaaccatcttaccatggacaacggatacgggaatatgctaagagcgggcatgggcggcggcggcggtggcggcgacccgcggctcaaggggcagctcagcttctcgtcgcggcaggggtcggtgatgtcccagatctcggagatgggcagcgaggacgaggagctcgccggcggcggcggcagcccggaggctggcagcaacggcggtggcgccgcacgcggcggctacggcggcgggtacgcgatggggtcctccgcctgggaggagccctcgccgccggcgacgtcgctcctcccggacagcagcctcccgtccaagcgcccccgcgacgacctgccgcggcagctcagcctcccggcggcgtccaagaacagcagcaagcccccctcctccgcctccgccgccgcgtcgccggagatggccgccatcgagaagttcctccagttccaggacgccgtcccctgcaagatccgcgccaagcgcggctgcgccacccacccccgcagcatcgccgagcgggtgaggaggacgcggatcagcgagcggatacggaagctgcaggagctcgtccccaacatggaaaagcaaaccaacactgctgacatgttggatcttgccgtggactacatcaaggagctccagaagcaggtcaaggtgttaaacgacagccgttccagctgcacctgctcggcgagcaagcagaagcacttcgccggctaa

SEQ ID NO: 172 - protein, 278 aa, Oryza sativa (japonica cultivar-group)
  G3742 polypeptide  Orthologous to G3086
MASAMAGLYRTVSSGGTESTAAAAGNSLLRQSSSPAGFLNHLTMDNGYGNMLRAGMGGGGGGGDPRLKGQLSFSSRQGSVMSQISEMGSEDEELAGGGGSPEAGSNGGGAARGGYGGGYAMGSSAWEEPSPPATSLLPDSSLPSKRPRDDLPRQLSLPAASKNSSKPPSSASAAASPEMAAIEKFLQFQDAVPCKIRAKRGCATHPRSIAERVRRTRISERIRKLQELVPNMEKQTNTADMLDLAVDYIKELQKQVKVLNDSRSSCTCSASKQKHFAG

SEQ ID NO: 173 - DNA, 450 bp, Oryza sativa (japonica cultivar-group)
  G3744 Predicted polypeptide sequence is orthologous to G3086
atgagctccgggtgggaggagtcgtcgctcatgtcggacacgaacatctccggcgtgaagcgccagcgcgactcgtcggagccgtcccagaacggcggcggcggcggcggcctggcgcaccagttcagcctgccgaagacctcgtcggagatggcggccatcgagaagttcctccagttccaggacgcggtgccctgcaagatccgcgccaagcgcggctgcgccacgcacccgcgcagcatcgccgagcgggtgaggaggacaaggatcagcgagcgaatcaggaagctgcaagaactcgtgccaaacatggacaagcaaaccaacactgctgacatgctggatttggctgttgactacatcaaggatcttcagaagcaggtcaagggattaaacgacagccgagctaactgcacctgctcagcgaagcatcagcagtactctggctag

SEQ ID NO: 174 - protein, 149 aa, Oryza sativa (japonica cultivar-group)
  G3744 polypeptide  Orthologous to G3086
MSSGWEESSLMSDTNISGVKRQRDSSEPSQNGGGGGGLAHQFSLPKTSSEMAAIEKFLQFQDAVPCKIRAKRGCATHPRSIAERVRRTRISERIRKLQELVPNMDKQTNTADMLDLAVDYIKDLQKQVKGLNDSRANCTCSAKHQQYSG

SEQ ID NO: 175 - DNA, 1164 bp, Oryza sativa (japonica cultivar-group)
  G3746 Predicted polypeptide sequence is orthologous to G3086
atgaacaggatgacggcgccgcacggggggatgccgccgccgccgatgccggcggcgggggggctggcgaggtacggctcggcgccggggtcgctgctggcgtcgatcgccgactcggtgatccggggccgcggggttggggttgtcgatcagctgcatcatcatcagcatcagcatcagcttccgccgccgccgccgccgcagcagcagcagatggtggggaggtacttctccgcggagtcgtcggggctcacctcctgcgagtccagctgccggacgacgacgacgacgtccacagcggcggcggccgatgtcgggcggcacccgctcgagcgcgcgtacggcggctccggcgagatccacgtcgacgcctcctccgccgccgtcccgctcttccgccacagcagctcccccgccggcctcctctcccgcctcatggctgacccgcacggcaatggcatggccgcgacgagagggatgggcggctactccggcggcggcggcgacgccggcgcgatggcgcacaggaggctgagctcgcagtggagcttctcgcggcaggacctgccgcagatatcggagatgggcggcctcatccccgacatcggggagagcatcgtcaccggcggcggcggcaacagctccagcgatggcgccggccacggcgcgcagtcctcctccttcctctcctccaggaacttctccatgagctcctgggacgacaccaactccatcatgttctcgcccccgagcagcagcaagaaggcccgcgtcgccgccgccgccgccggcgaccacggcgacgacatggtctccagcttcagcaacatcgactcccagtttggcttgtcgaagcagtcgtcgctggagatggccggcatggatgacttcttgcagctccagccagactccgtcgcctgcagggcccgggcaaagcgcggctgcgcgacgcacccgcggagcatcgctgagagggagaggagaacgaggattagcaagaggctgaagaagctgcaggatctcgtgccgaacatggacaagcaaacgaatacatcagacatgttggatattgctgtaacctacatcaaggagcttcagggccaagttgagaagctaaaacatgaccaagcaaactgcacttgctcaggcaagcacgattgctga

SEQ ID NO: 176 - protein, 387 aa, Oryza sativa (japonica cultivar-group)
  G3746 polypeptide  Orthologous to G3086
MNRMTAPHGGMPPPPMPAAGGLARYGSAPGSLLASIADSVIRGRGVGVVDQLHHHQHQHQLPPPPPPQQQQMVGRYFSAESSGLTSCESSCRTTTTTSTAAAADVGRHPLERAYGGSGEIHVDASSAAVPLFRHSSSPAGLLSRLMADPHGNGMAATRGMGGYSGGGGDAGAMAHRRLSSQWSFSRQDLPQISEMGGLIPDIGESIVTGGGGNSSSDGAGHGAQSSSFLSSRNFSMSSWDDTNSIMFSPPSSSKKARVAAAAAGDHGDDMVSSFSNIDSQFGLSKQSSLEMAGMDDFLQLQPDSVACRARAKRGCATHPRSIAERERRTRISKRLKKLQDLVPNMDKQTNTSDMLDIAVTYIKELQGQVEKLKHDQANCTCSGKHDC

SEQ ID NO: 177 - DNA, 531 bp, Zea mays
  G3755 Predicted polypeptide sequence is orthologous to G3086
atgtcccagatctcagagatggacagcgaggaggtcggagggagcagcccagaggctgccggcggcggcagggggtacatccctgggtacccaatgggctctgggtgggaggactcgtcggctctcttgtcagacaatttgtctggcatcaaacgcccccgggactcgtcggagcctggccagagcggccttacgcaccagttcagcgtgcccaagacgtcgtccgagatggcaactattgagaaattcctccagttccaggacgccgtgccttgtaagatccgtgccaagcgggggtgcgccactcatccacgcagcatcgctgagagggtgaggagaacaaagatcagtgagcgaatccgaaagctgcaagaactcgttccaaatatggacaagcaaaccaacacatctgacatgctggatttggctgtcgactacatcaaggatctccagaagcaggttaaggtgctaaaggagagccaagataattgcacctgctcagcaagcaagaaccagcagcactcctgctga

SEQ ID NO: 178 - protein, 176 aa, Zea mays
  G3755 polypeptide  Orthologous to G3086
MSQISEMDSEEVGGSSPEAAGGGRGYIPGYPMGSGWEDSSALLSDNLSGIKRPRDSSEPGQSGLTHQFSVPKTSSEMATIEKFLQFQDAVPCKIRAKRGCATHPRSIAERVRRTKISERIRKLQELVPNMDKQTNTSDMLDLAVDYIKDLQKQVKVLKESQDNCTCSASKNQQHSC

SEQ ID NO: 179 - DNA, 711 bp, Glycine max
  G3763 Predicted polypeptide sequence is orthologous to G3086
atggcaaatcttgcagcagcattgagagatgtggcaagttttaggggctgtgatgtctcaaatggacaagctattacatcctctagtggattgcatggtactttgaacttctcatctaggccatcctcttgctccacccggatgccacagattgctgaaaatggaaatgaagatgtggaagcaaattgtgttgaaagtagaaacctgagaaatgacaatatcaacaccactaaatgttacatgcctagtttcaccactgacttctgggatggttctgcattcagtgcctccagaacagctagtaacagaggtgaaatctcattttccacttcaaaggctatggatattcaggatgaagattttggataccaaaaagttggtttgacccaccatttgagtctgcctggctcttccagtaggatggctacaatggagaagctttatcaaattcaaggatctgttccatgtaaaattcgtgccaagagaggttttgccactcacccgagaagtattgctgaaagggaaaggagaacacgaattagcgcaagaatcaagaaattgcaagaccttttcccaaaatcagacaagcaaacaagcactgcagatatgttggatttggcagttgagtacattaaagacttgcagaaacaagttaagattctcagagatactagggcaaattgcacttgtacaagcaatcagaagcactga

SEQ ID NO: 180 - protein, 236 aa, Glycine max
  G3763 polypeptide  Orthologous to G3086
MANLAAALRDVASFRGCDVSNGQAITSSSGLHGTLNFSSRPSSCSTRMPQIAENGNEDVEANCVESRNLRNDNINTTKCYMPSFTTDFWDGSAFSASRTASNRGEISFSTSKAMDIQDEDFGYQKVGLTHHLSLPGSSSRMATMEKLYQIQGSVPCKIRAKRGFATHPRSIAERERRTRISARIKKLQDLFPKSDKQTSTADMLDLAVEYIKDLQKQVKILRDTRANCTCTSNQKH

SEQ ID NO: 181 - DNA, 1356 bp, Glycine max
  G3764 Predicted polypeptide sequence is orthologous to G3086
atgagtgttatgtatagtcctgttctcaattactcagatgtggagcatcagctaaggaaaaatcaagacatggattcaagtattggacatccacaacaacactgtcaccaacccaattctggactattgaggtattgttctgctccaagctcattgctggcaagcctcattgacaacaccattcatggctgtgtcaacgaggaatcgttcacaagtgagaatcatcatcatcatcagcagcagcagcagcagcattatcttccatctacaagttcagaaatggagaccatgttatccaaattgctaccatccaacaatggatggagcaattcagaagctttgcaagaatttggaggcaagccctgtgaagcaggaaataggggaatctattccacaagagccaccacaacagaatggttattcttatggtggctctcagttgatttaccaatctcagcaaattcaaggccttgccaaatggtggatcttccagtggcttctggcagtgcttttgatggctcttttggtgtggtgcactccatggcttcagaggactccattcaatctaaaatgggtatcaggaattgctccaatctctttaggcaaaagagttcccctgctgcatttttctccattgaaaatgatcttgcagcattgagagaagtaggaagctttaaagccgatgatgtttcaaatggactagttactgcatcaactggtgggttgcatagttctcatactttctcatctaggccatcttcatgcttgaaacggttgccacaaatagccgaaaatggaaatgaaagcctagaagaaaattgtgaccaaagtagaaacctagtaaatgacaatggtagctcaaaatgttacatacctagcttcaccaatgaattatgggaaagttctgcattcaatgccccaaaaacagagaatgaagatgaaatcatgttttccacttcaaatattttggaatctcaggaagcagatttcagctttcaaaatctgggtttgactcaccatttgagtctacctagctcttctactaagatgtcatccatagaaaagtttcttcagattcaaggttctgttccttgtaaaattcgagccaaaagaggctttgccactcacccaagaagtattgcagagagggtaagaagaacaagaattagtgaaagaatcaagaaactgcaagacctttttccaaaatcagaaaagcaaacaagcacagcagatatgttagatttggcagttgagtatattaaggacctgcagcaaaaagttaagatactctcagattgtaaggcaaagtgcaaatgtacaagtaatgagaagcattacactagaacttgtgcttga

SEQ ID NO: 182 - protein, 451 aa, Glycine max
  G3764 polypeptide  Orthologous to G3086
MSVMYSPVLNYSDVEHQLRKNQDMDSSIGHPQQHCHQPNSGLLRYCSAPSSLLASLIDNTIHGCVNEESFTSENHHHHQQQQQQHYLPSTSSEMETMLSKLLPSNNGWSNSEALQEFGGKPCEAGNRGIYSTRATTTEWLFLWWLSVDLPISANSRPCQMVDLPVASGSAFDGSFGVVHSMASEDSIQSKMGIRNCSNLFRQKSSPAAFFSIENDLAALREVGSFKADDVSNGLVTASTGGLHSSHTFSSRPSSCLKRLPQIAENGNESLEENCDQSRNLVNDNGSSKCYIPSFTNELWESSAFNAPKTENEDEIMFSTSNILESQEADFSFQNLGLTHHLSLPSSSTKMSSIEKFLQIQGSVPCKIRAKRGFATHPRSIAERVRRTRISERIKKLQDLFPKSEKQTSTADMLDLAVEYIKDLQQKVKILSDCKAKCKCTSNEKHYTRTCA

SEQ ID NO: 183 - DNA, 687 bp, Glycine max
  G3765 Predicted polypeptide sequence is orthologous to G3086
atgaaaggtgttggaaactatagtggggtcaatggcaatgatggtgaacttagtctatctatgaacagaatgaagaatcacattagcttctcatcaataagtccttcttcttccttgggaatgctatcaccaacctccaaaatgggcacggagggtattagggtaactagacctgaggatgggagacagggaagttgcaatggtgatgctcgatattatggtcctggattcccttatgcttcttggaatgagccctcacaccccaaaagacagcgaagtagtaatgatgagttactttttgattctcagaatggagagccaggaaatcaagttcaaaggctttcgcatcatttgagtttgccaagaacgtcgtcggagatgtttgctatggataatttgcttcagttctcagattctgttccttgtaaaatcagagcaaagagaggctttgctactcatcctcgaagcattgccgaaagggtgagaagaacaaggatcagtgaacgaataagaaaattgcaagagcttgttccaaccatggacaagcaaactagcacagcagagatgttggacttggctttagactacataaaagatcttcagaaacaattcaagactctgagcgataaacgggctaaatgcaaatgtataaacatgcagaagtcagaagcagatcgagttgcttga

SEQ ID NO: 184 - protein, 228 aa, Glycine max
  G3765 polypeptide  Orthologous to G3086
MKGVGNYSGVNGNDGELSLSMNRMKNHISFSSISPSSSLGMLSPTSKMGTEGIRVTRPEDGRQGSCNGDARYYGPGFPYASWNEPSHPKRQRSSNDELLFDSQNGEPGNQVQRLSHHLSLPRTSSEMFAMDNLLQFSDSVPCKIRAKRGFATHPRSIAERVRRTRISERIRKLQELVPTMDKQTSTAEMLDLALDYIKDLQKQFKTLSDKRAKCKCINMQKSEADRVA

SEQ ID NO: 185 - DNA, 351 bp, Glycine max
  G3766 Predicted polypeptide sequence is orthologous to G3086
atgttatcacatcacttgagtttaccaaaaacttcagcagagatgattactatggagaagttgcttcagttccctgattctgttccttgtaaaatcagagcaaagcgaggctgtgctactcatcctcgaagcattgctgaaagggtgagaagaactcggatcagtgaaagaatgaggaaattacaagagcttgtcccacacatggataagcaaaccaacacagcagacatgttggacttggctgttgaatacattaaagatcttcagaaacaattcaagactctaagtgaaaaaagggcaaactgcaagtgtataagcatgccaaaggcagatacaaatcaaattgcttga

SEQ ID NO: 186 - protein, 116 aa, Glycine max
  G3766 polypeptide  Orthologous to G3086
MLSHHLSLPKTSAEMITMEKLLQFPDSVPCKIRAKRGCATHPRSIAERVRRTRISERMRKLQELVPHMDKQTNTADMLDLAVEYIKDLQKQFKTLSEKRANCKCISMPKADTNQIA

SEQ ID NO: 187 - DNA, 666 bp, Glycine max
  misc_feature (234)..(234): n is a, c, g, or t
  G3767 Predicted polypeptide sequence is orthologous to G3086
atggggactttgggggctgttaataacagtatcgaagatgcaaaattttctagttcgagaaggttgaagaatcaaccgaactattcttcgtcggggagaatgtcgtccaatgctgaaattggggacaaagggaatcgagaaagtagtccagacaatgaagcttttgctgatggtaacgattttatcaccggtttccaagttggtcattgggatgatgctgcaatcatgtctganaacgttggtggtctcaaaagatttagagaaaacgattcaaaaccattttctggcttaaatgcggctgagactcagaatgaaacaggacagactcatgctcctttggcccatcagttgagtttgccaaatacttcagctgaaatagctgccattgagaagtttctgcagttttcagattctgttccgtgcaaaatccgtgccaaacggggctgtgccactcacccaagaagcattgcagagagggttagaagaactaaaattagtgagcgtatgaggaaacttcaagatcttgtcccaaacatggacaagcaaactaacacagctgatatgttggacttggctgtggattacatcaaagaccttcaaaagcaagttcagacgctttcagattgtcatgcaaagtgtacgtgttcacacgagaagcaacaataa

SEQ ID NO: 188 - protein, 221 aa, Glycine max
  misc_feature (78)..(78): Xaa can be any naturally occurring amino acid
  G3767 polypeptide  Orthologous to G3086
MGTLGAVNNSIEDAKFSSSRRLKNQPNYSSSGRMSSNAEIGDKGNRESSPDNEAFADGNDFITGFQVGHWDDAAIMSXNVGGLKRFRENDSKPFSGLNAAETQNETGQTHAPLAHQLSLPNTSAEIAAIEKFLQFSDSVPCKIRAKRGCATHPRSIAERVRRTKISERMRKLQDLVPNMDKQTNTADMLDLAVDYIKDLQKQVQTLSDCHAKCTCSHEKQQ

SEQ ID NO: 189 - DNA, 798 bp, Glycine max
  G3768 Predicted polypeptide sequence is orthologous to G3086
atggagcaaggatcgttttcaatgggactcaggcatagtggaaataattctaaccttaccaggcatagtagctctcccgcaggactattttcccaaattaacattgaaaatgtgtatgctggtgtgagaggcatggggagtttgggagctgttaacaacagtatcgaagatgcgaaattttctagttcgaggaggttgaagaatcaaccgaactattcttcgtcggggagaatgtcgtccattgctgaaattggggacaaagggtatagagaaagtagtccagacagtgaagcttttgctgatggtaacgattttatggccggttaccaagttggtcattgggatgatactgcaatgatgtctgacaacgttggtggtctcaaaagatttagtgaagaagattcaaaaccattttctggcttaaatgcggttgagactcagaatgaaacgggacagactcatgctcctttggcccatcagttgagtttgccaaatacttcagctgaaatggctgccattgagaagtttctgcagttttcagattctgttccgtgcaaaatccgtgccaaacggggctgtgccactcacccaagaagcattgcagagagggtaagaagaactaaaattagtgagcgtatgaggaaacttcaggatcttgtcccaaacatggacaagcaaactaacacagctgatatgttggacttggctgtggattacatcaaagaccttcaaaagcaagttcagacactttcagattgtcatgcaaagtgtacgtgttcacacgagaagcaacaataa

SEQ ID NO: 190 - protein, 265 aa, Glycine max
  G3768 polypeptide Orthologous to G3086
MEQGSFSMGLRHSGNNSNLTRHSSSPAGLFSQINIENVYAGVRGMGSLGAVNNSIEDAKFSSSRRLKNQPNYSSSGRMSSIAEIGDKGYRESSPDSEAFADGNDFMAGYQVGHWDDTAMMSDNVGGLKRFSEEDSKPFSGLNAVETQNETGQTHAPLAHQLSLPNTSAEMAAIEKFLQFSDSVPCKIRAKRGCATHPRSIAERVRRTKISERMRKLQDLVPNMDKQTNTADMLDLAVDYIKDLQKQVQTLSDCHAKCTCSHEKQQ

SEQ ID NO: 191 - DNA, 948 bp, Glycine max
  G3769 Predicted polypeptide sequence is orthologous to G3086
atgaataatgaaccacttgttctccaacaacaacagcagcagcagcaacaacaacaacaaagtaataatatgtataattatggctcttctggtactcagaatttttaccaaagcactggacgaccacctttgccaaaccagatgaagactggtcatggaagtagttctaatcttatcagacatggtagctcacctgctggattgttttcaaacattaacattgatattactggctatgctgctgttgtaaggggcatgggaactatgggagctgctgctaataacaccagcgaggaagcaaacttttcaccagcaacaaggatgaagaataatgcaccaaacttctcttcaggactaatgtcatcaagggctgaagttggaaacaagagcaatacacagaacaataatgcagaaaatgaagggtttgctgaaagccagggcaatgagtttatccctgcaggtttccccgttggtccgtggaatgattctgcaatcatgtctgacaacgtgacaggtctgaagagatttagagatgaagatgtgaaaccattttctggtggtttaaatgcacctgaaagtcagaatgaaactggaggccaacaaccttcttcttctgctttggctcatcaattgagtttgccaaatacttctgcagaaatggcagccattgagaagtttctgcagctctcagattctgttccttgcaaaattcgtgccaaacggggctgtgccactcacccaagaagcattgcagagagggttagaagaactaaaattagtgagcgaatgaggaagctacaagatctcgttcccaacatggataagcaaacaaacacagctgacatgttggacttggctgttgagtacattaaagaccttcaaaaccaagttcagactctttcggacaatcgggcaaagtgtacgtgttcacacaagaagcagcaataa

SEQ ID NO: 192 - protein, 315 aa, Glycine max
  G3769 polypeptide  Orthologous to G3086
MNNEPLVLQQQQQQQQQQQQSNNMYNYGSSGTQNFYQSTGRPPLPNQMKTGHGSSSNLIRHGSSPAGLFSNINIDITGYAAVVRGMGTMGAAANNTSEEANFSPATRMKNNAPNFSSGLMSSRAEVGNKSNTQNNNAENEGFAESQGNEFIPAGFPVGPWNDSAIMSDNVTGLKRFRDEDVKPFSGGLNAPESQNETGGQQPSSSALAHQLSLPNTSAEMAAIEKFLQLSDSVPCKIRAKRGCATHPRSIAERVRRTKISERMRKLQDLVPNMDKQTNTADMLDLAVEYIKDLQNQVQTLSDNRAKCTCSHKKQQ

SEQ ID NO: 193 - DNA, 474 bp, Glycine max
  G3771 Predicted polypeptide sequence is orthologous to G3086
atgcaacccacatccggcggcggcgggctggcaaggttccgttcagctccggcgagctggttagaatcagttctgttgaaggaagaggaagaagaagaagaccccttaagcttcactcaactgctttccactatcgatgatgctccctctcattctcaacaccaactctatggtgccgctctctcaaacaaggataaaacacctgaaatcttcatgttagaagattccgttccttgcagagtgagggctaagcgtggctgtgctactcatcccaggagtattgctgaaagggttcgcaggactcgtatcagtgaccgcatcagaaagctgcaagaacttgtgccaaacatggataagcaaacaaatactgcagatatgttagatgaggctgtagcgtatgtcaagtttctacaaaagcaaattgaggaactgtcagagcaccaacggaggtgtaaatgcgtggttcaagagtaa

SEQ ID NO: 194 - protein, 157 aa, Glycine max
  G3771 polypeptide  Orthologous to G3086
MQPTSGGGGLARFRSAPASWLESVLLKEEEEEEDPLSFTQLLSTIDDAPSHSQHQLYGAALSNKDKTPEIFMLEDSVPCRVRAKRGCATHPRSIAERVRRTRISDRIRKLQELVPNMDKQTNTADMLDEAVAYVKFLQKQIEELSEHQRRCKCVVQE

SEQ ID NO: 195 - DNA, 861 bp, Glycine max
  G3772 Predicted polypeptide sequence is orthologous to G3086
atgtatccctcttcctcttcctcctcctcctcttcctctcagtccatgacccaagctggcctcactcgctacggttccgcccccggttctcttctcaccagcacggttgattctttattggtggatcccgtcccagtccctacttttccggagagtcttctgagtctccctgcaaagagcaaagatctttccacaaccaccccccctccttcgcttcctccttgctccgccagaaaagctctctcgacggcttcctttcccatctctccaaacaccatggggtgggtttcaaccatcacccccggtggtttatcaaattcaaattcaaattcaaattgttctctcttgaagtctcaactcagcttcacccacgaatctctttccaacactgttaatgttgatccctccagcaccaccttcggaatggatccctgggacaacaattccatcgccttttctgcaacttcaaccaagcgctccaaaaccaacaccaatgatcctgacattttacattccctgaattcggccttggaatcacagttcaatcttccacatacaagtctggaaatgtcaaccgtggacaagctattgcacattcctgaagattctgtcccttgtaaaatccgtgctaagcgaggttgtgctactcatccccgtagcattgccgagcgggagagaagaacaaggatcagtggcaagctcaagaaattacaggaccttgtacccaatatggataagcaaacaagctatgcagacatgctcgatttggccgttcaacacattaaaggtcttcaaactcaggttcagaagcttcacaaagaaatggagaattgcacttgcggatgcaaacaaagcaaataa

SEQ ID NO: 196 - protein, 286 aa, Glycine max
  G3772 polypeptide  Orthologous to G3086
MYPSSSSSSSSSSQSMTQAGLTRYGSAPGSLLTSTVDSLLVDPVPVPTFPESLLSLPAKSKDLSTTTPPPSLPPCSARKALSTASFPISPNTMGWVSTITPGGLSNSNSNSNCSLLKSQLSFTHESLSNTVNVDPSSTTFGMDPWDNNSIAFSATSTKRSKTNTNDPDILHSLNSALESQFNLPHTSLEMSTVDKLLHIPEDSVPCKIRAKRGCATHPRSIAERERRTRISGKLKKLQDLVPNMDKQTSYADMLDLAVQHIKGLQTQVQKLHKEMENCTCGCKQSK

SEQ ID NO: 197 - DNA, 1656 bp, Pinus taeda
  G3782 Predicted polypeptide sequence is orthologous to G3086
atgtcatatgtcaaaatgctaaactctcgagctcagcccattagcactggtttaagcattccatctctgagtgttggacatactgatgtaaatggaatccaaatatcgttctcccagtaccccatggactcagagaagatgcctcagatgcagcaacagacaaataatgtagactttatggacctcgattataagccccctctttgcaatgtttcccaagcagatggagtaatggcattaacagaaagaggttcgtccaacaattttcagggaccaacaggattgatgcgctaccattcggcgcccagctcatttttttcaagtctaggagaagaggaaaataataacattatatcagagtatttctctggtaattcttcgaatccactgcaatcaaataccaaaccactgcagcaaaatcaacctagtatattgagttttcatctcagggaaaatgaaccagcaaagcatcttggcgaacgcaatgaaatatctgaaaaagaaatgcacgccagctcccttccctcaaaagaagtgcagggaaatgtttctagagaagatctaggcaagcaccatcctcttgatgcaatccttgagaatgtaccggatgtatcccaagacagttttggcacctctcaaatgtcattgatgagccaagttcaagtttctgaaccaagtggacaacacatcgattcatcctaccaaatgaattcagtttgctgcgatacccttgatcagtcaggaggaaggatgggcaatgcatactcctcaacatccaagaatacacttattcgacatagtagctccccagctgggctactctctgaactagttgctgaaggccgaggtacttttgaaagtggtttcatggagggaacagtcagaaatagtattggtgtgggaaactcatgtggggatatcattataccaaatagagttcaaagacaaatgaaccgtttgcagcagaatagttctcctggactattatcccaactatctgtggatatgagtgtaccagaaatggttgacaggctcaacatggctatggttggatcttctgcagaaaatcaagctgggagcagttccgatgatagtagtttaggtagtgggaatgctggacaaggatatatttcaaatttctctgttaagtcatgggatgacgaggcaatgactcctggaaattttgcaggaatgcaaaatggggctaactttacagcaagaaagcgtgcaaaagaattggatatgaaattaatgcaaggcttgaataactcagatcaccagaaggtagaaggaggaattcgaggtgcatctgcattaacaaatcatccatacaatttgccaagatccacatcttcagaacttgcaatggaagaattcctgcaagatgctgttccatgcaaggtccgggcaaaaagaggctgtgcaacgcacccacggagcattgctgaaagggttcgaagaacacgaatcagtgaaagaatgagaaaactgcaggaacttgtgccaaacagtgacaagcaaacagtaaatattgccgacatgttagatgaggccgttgaatatgtcaagtctcttcagaagcaggtccaggaacttgcggaaaatcgagccaagtgtacctgcacacataatccggattgtgcatacaaaacataa

SEQ ID NO: 198 - protein, 551 aa, Pinus taeda
  G3782 polypeptide  Orthologous to G3086
MSYVKMLNSRAQPISTGLSIPSLSVGHTDVNGIQISFSQYPMDSEKMPQMQQQTNNVDFMDLDYKPPLCNVSQADGVMALTERGSSNNFQGPTGLMRYHSAPSSFFSSLGEEENNNIISEYFSGNSSNPLQSNTKPLQQNQPSILSFHLRENEPAKHLGERNEISEKEMHASSLPSKEVQGNVSREDLGKHHPLDAILENVPDVSQDSFGTSQMSLMSQVQVSEPSGQHIDSSYQMNSVCCDTLDQSGGRMGNAYSSTSKNTLIRHSSSPAGLLSELVAEGRGTFESGFMEGTVRNSIGVGNSCGDIIIPNRVQRQMNRLQQNSSPGLLSQLSVDMSVPEMVDRLNMAMVGSSAENQAGSSSDDSSLGSGNAGQGYISNFSVKSWDDEAMTPGNFAGMQNGANFTARKRAKELDMKLMQGLNNSDHQKVEGGIRGASALTNHPYNLPRSTSSELAMEEFLQDAVPCKVRAKRGCATHPRSIAERVRRTRISERMRKLQELVPNSDKQTVNIADMLDEAVEYVKSLQKQVQELAENRAKCTCTHNPDCAYKT

SEQ ID NO: 199 - DNA, 918 bp, Zea mays
  G3794 Predicted polypeptide sequence is orthologous to G1792
attacttgtgcacttgggtgcagtgcctgcagtataatcaagttagggtttaaaagaacctcgaccgcgatcgtatatagatccagattatcattagttattagaccactgtgatatcgatggacgacggcggcgagccaaccaagtaccgcggcgtgcggcgccggccgtcggggaagttcgccgccgagatccgcgactccagccggcagagcgtgcgcatgtggctgggcaccttcgacacggccgaggaggccgcaagggcgtacgaccgcgcggcctacgccatgcgcggccaaatcgccgtgctcaacttccccgccgaggcgcgcaactacgtgcgcggcgggtcgtcgtcgtcccgccagcagcagcagggaggaggaggaggaggaggaagtggcggcggcgccggtcagcaggtgatcgagctggagtgcctggacgatcaggtgctgcaggagatgctcaagggcggcgacgggaaaaaatagttgttagcgtatctgatcacaggtgcacgtgttgaaactgattatgaccaggcgatcgatcccatcttgtgcatgcggcctgccaaagttgctgggtcttctcatcgacctatatatatatgcttctcgatccatatatatatcataaatgcatgcagggtgcatgcatgtaccaagtttggaattataatgctcttggtgctgaattgaagtatactagtatatatagtgtgatccatgtattgaaaaggttgttttgcttaatcgcgtcatgattgcacacgtgcttgtttctgcttaaacaacccatatatatagccggctctggcctttgtcaagtctgcaatccttatacatcgttggtaattcatgcatgagttctatgtaactgcaatttagataaattgtagctaatataatagtc

SEQ ID NO: 200 - protein, 124 aa, Zea mays
  G3794 polypeptide  Orthologous to G1792
MDDGGEPTKYRGVRRRPSGKFAAEIRDSSRQSVRMWLGTFDTAEEAARAYDRAAYAMRGQIAVLNFPAEARNYVRGGSSSSRQQQQGGGGGGGSGGGAGQQVIELECLDDQVLQEMLKGGDGKK

SEQ ID NO: 201 - DNA, 760 bp, Capsicum annuum
  G3795 Predicted polypeptide sequence is orthologous to G1274
aaataatcccagtgcaaacatgcttgatgggagttttagatcattggactcacctgacagtgatgatttctcaaaccacctaattaactttgagctttctgatattctcgaaatagataattggcccattcaacaagatccgacactcataccccagtactcaaattatgcagcaaaccaagtggttaacaccagcagttaccaggaagaacctagcaacaacattggaagcagcagcagcaagaggaaagaagtaaaggacaaggttgctttcagaacgctatcacagattgaaatactagacgatggctataagtggagaaagtatggaaagaagatggtgaaaaatagtcccaacccgaggaattactataggtgctccgtagaaggttgtccagtgaagaagagagttgaacgagacaaagaggactctcggtatgtgataaccacctacgagggtgtccacaaccatcaaggtctatccccattctgattcctgtaacagagctcgagtttgaaagttactatgactcttgcacggtagctagctaaatcagggttctactgccagtaaattgaatcctgacagcttggcgagttcataaccaaacattgtggggtggtcagacggaggcatcgatctgtaacttaaaagtaatcgttagaacatttcgtgcccttcagttggcatgtagtcttatcctgcttcctacatgatttatatatcctacagcactatcaactaaaaaaaaaaaaaaaa

SEQ ID NO: 202 - protein, 157 aa, Capsicum annuum
  G3795 polypeptide  Orthologous to G1274
MLDGSFRSLDSPDSDDFSNHLINFELSDILEIDNWPIQQDPTLIPQYSNYAANQVVNTSSYQEEPSNNIGSSSSKRKEVKDKVAFRTLSQIEILDDGYKWRKYGKKMVKNSPNPRNYYRCSVEGCPVKKRVERDKEDSRYVITTYEGVHNHQGLSPF

SEQ ID NO: 203 - DNA, 712 bp, Lactuca sativa
  G3797 Predicted polypeptide sequence is orthologous to G1274
ggcataccaaaatgaattattatgatcatcaaatgtctaaagcctacagttacagatcagtagactcgcctgacatggactatgatgttccaaaccagcaaacttatgagtttgttgagagctttctcagctttgatgattggataactgaagataaagcatccactgttcctgagtatcaagatcatactcctgtttacccttctgccaccattgaagatggtggtctgtcgatcggaagtagcagcagcaacagccatcttcatgatggaagtagaagcagggccacaggatttgggcaggctcaaaatggcaaaaaagagaaagtcgccttcaaaacaaaatcccaagttgagatcctagatgacggttttaagtggaggaaatatggcaaaaagatggttaaaaacagtccaaacccaaggaattattatcgttgttcagcagcaggatgttcggtgaaaaagagagttgaaagggatgtagaggatgcacgatatgtaatcacaacctacgagggtattcacaaccaccaacgcccttctaactactgatagcttgtactacgatttgttaatgtatgctaaagaatagttgtttttctaagcttactccatcactagcttattgaaaagaaagttgtagttcggttacttattttcttcaaccgaccaaggttatgaatcgttttagaatataattgtttttaact

SEQ ID NO: 204 - protein, 180 aa, Lactuca sativa
  G3797 polypeptide  Orthologous to G1274
MNYYDHQMSKAYSYRSVDSPDMDYDVPNQQTYEFVESFLSFDDWITEDKASTVPEYQDHTPVYPSATIEDGGLSIGSSSSNSHLHDGSRSRATGFGQAQNGKKEKVAFKTKSQVEILDDGFKWRKYGKKMVKNSPNPRNYYRCSAAGCSVKKRVERDVEDARYVITTYEGIHNHQRPSNY

SEQ ID NO: 205 - DNA, 866 bp, Sorghum bicolor
  G3802 Predicted polypeptide sequence is orthologous to G1274
gcacgaggctgatacacaagcaaggcggctagctacagctagctggtgcgtgcagtgcatgcaaatggcggcttccctgggactgaaccctgaagctctcttcgcttcatactcgtctgcctactcctcctcctcgccgttcgtgtccgactacgcggcgagcttcccggcggccgtcgactccgccacggccttctccgcggagctcgatgaccttcaccacttcgactactcaccggcgccgatcttcacagctgtcggagccggggctggcggcgatcgcaacgagaagatgatgatgtggtgtgagggcggtggtgatgaaaagagactcagaagcagtggaaggatcgggttcagaacgagatcagaggtggagatcttggacgatggattcaaatggaggaagtatgggaagaaggctgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagtcccggagccgccgccatcatccagtacggcggcggcggcggcaatagcggcttctacagcccgccgcacagtggctcgccgtcggctgcctcatactcgggctccttcgtcttctgacttttccgggccttgaccttgacccagagtgatttacctttaccccagtcgtaggatgagaagagtgttcagagagatcagttcagcggccggctaaattccgacctgcttgtacatttttacacacttgtgcagtacaagtaataatatttaagctagaagcagtgtactctactttatttacctc

SEQ ID NO: 206 - protein, 206 aa, Sorghum bicolor
  G3802 polypeptide Orthologous to G1274
MQMAASLGLNPEALFASYSSAYSSSSPFVSDYAASFPAAVDSATAFSAELDDLHHFDYSPAPIFTAVGAGAGGDRNEKMMMWCEGGGDEKRLRSSGRIGFRTRSEVEILDDGFKWRKYGKKAVKNSPNPRNYYRCSSEGCGVKKRVERDRDDPRYVITTYDGVHNHASPGAAAIIQYGGGGGNSGFYSPPHSGSPSAASYSGSFVF

SEQ ID NO: 207 - DNA, 643 bp, Glycine max
  G3803 Predicted polypeptide sequence is orthologous to G1274
gtctttgcaagtgacacatatctagctattacctcaatggattactattttggaaaccctaatcctaaaccttatgataaccgtcactctgccgtagtaaacacggaatctccttcctccgagttcatgctatctgattatctcgtgttggaagatgctgtcgataatcaagagtcttggtcacaaagcactgaaactgaatcatcggagaaaggaaactccagcgatgtcagtcatgggtttggtgatgcaaccttcagcaacaccaacatgcatataaagtgcgaaaataatgggataaagcgaaagaaggaagaagtgagtcaaatgatcacgtttagaaccagatcgcagcttgaggttatggatgatggatataaatggaggaaatacggaaagaagacagtgaagaacaatcccaacccaaggaactactacaagtgttcaggtgaaggatgcaatgtgaagaaaagggtggaaagagacagggatgactcgaactatgttttaacaacgtacgacggtgtccacaatcatgagagcccgtcgactgcctactacagccaaattcccttggtgcattctaaccatgattggccccagctgcacccttctgcaaactcatgatcctcttcaatacagt

SEQ ID NO: 208 - protein, 196 aa, Glycine max
  G3803 polypeptide Orthologous to G1274
MDYYFGNPNPKPYDNRHSAVVNTESPSSEFMLSDYLVLEDAVDNQESWSQSTETESSEKGNSSDVSHGFGDATFSNTNMHIKCENNGIKRKKEEVSQMITFRTRSQLEVMDDGYKWRKYGKKTVKNNPNPRNYYKCSGEGCNVKKRVERDRDDSNYVLTTYDGVHNHESPSTAYYSQIPLVHSNHDWPQLHPSANS

SEQ ID NO: 209 - DNA, 823 bp, Zea mays
  misc_feature (9)..(9): n is a, c, g, or t
  misc_feature (802)..(802): n is a, c, g, or t
  G3804 Predicted polypeptide sequence is orthologous to G1274
ccggccggngatattcaggcaggcgcattgactggtacgcatacaactacaagcaaggcggctagctacagcggctagtgcgcgcgtggtgcaggcgcagctagctagtgcgtgcaatggcgacttcgctgggactgaaccctgaagatctcttcacttcgtactcgtcttcctactactcctcgccgccgttcatgtccgactacgcggcgagcttcacgccggcgggcggggactccacggccttctcctcggagctcgacaaccttcaccacttcgactactcaccggcgccgatcgtcactgctgccggagccggggctgggggcggcgatcgcaacgagaagatgatgtggtgtcagggtggtggtgacgagagaagactcagaagcaacggaaggatcgggttcagaacgaggtcacaggtggagatcttggacgacggattcaagtggaggaagtacgggaagaaggccgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagccccgcagccgctgctatcatcgtcccgtacggcaacggcggcggcaatagcggcttctacagcccgccgcacagcggctccccgtcggccacctcctactcgggctccctagtcttctgacttttccgggccttgacccatagttacctttacaccccagtcgtcggatgagaagaatcttcagcggncggctaaacagtctcaactgc

SEQ ID NO: 210 - protein, 205 aa, Zea mays
  G3804 polypeptide  Orthologous to G1274
MATSLGLNPEDLFTSYSSSYYSSPPFMSDYAASFTPAGGDSTAFSSELDNLHHFDYSPAPIVTAAGAGAGGGDRNEKMMWCQGGGDERRLRSNGRIGFRTRSQVEILDDGFKWRKYGKKAVKNSPNPRNYYRCSSEGCGVKKRVERDRDDPRYVITTYDGVHNHASPAAAAIIVPYGNGGGNSGFYSPPHSGSPSATSYSGSLVF

SEQ ID NO: 211 - DNA, 1368 bp, Glycine max
  G3810 Predicted polypeptide sequence is orthologous to G922
atgatgtcactttcacctagcttaggttctcccaacaatctcttgtttagggaaatgaaatccgaggaaaggggtttgtacttgatccatttgttgctcacttgtgcaaaccatgtagctgctggtaaccttgaaaatgcaaacaccacacttgagcaaatttccatgcttgcttcccctgatggggacactatgcagcgaatcgcaacatattttatggagtcgcttgctgatcggattcttaaaacatggcctgggatccacagagccctcaactcaaccagaatgactttgatatccgacgaaattctggttcagaagcttttctttgagcttttccctttcttgaaggtagcatttgttctcacaaatcaggccatcattgaagcaatggaaggggagaaagtgattcacataattgatctcaatgctgctgaagctgctcagtggattgctctccttcgagtattaagtgcgcatcccgaaggccctcctcatttgagaatcaccggggttcatcagaaaaaggagattctggatgaggtggctcatagactaactgaagaagcagaaaagttggatataccgttccaattcaaccctgtggcaagcaaattagaaaatcttgattttgacaaacttcgggtgaaaactggggaggcactagcaataagttccattctccaattgcatacccttttggcctgggatgatgaagccatgcagagaaagtctcctcttctgttaaaaagctcaaatggaattcacctgcaaagagttctgccaatgggccaaagcacattgggtgatttgcttgagaaagatatggttaatgggtacactccaagtcctgactcaacctcatcatctccatcatctttaactacttccaattcaaggcccagggggcgctttcttaatgccttgtggggattatcaccaaaggtcatggttgtgacagaacaagactgtaatcacaatggtccaactctgatggataggcttcttgaagctctatactcttatgcagcattgtttgattgtttggaatccactgtctcaagaacatcattggagagattaagggtggagaagatgctttttggggaggaaataaagaacatcattgcatgtgagggatctgaacgaaaggaaagacatgaaaagctggaaaagtggttccagagatttgatctagctgggtttggcaacgtgcctttgagctactttggtatggtgcaagcaaggaggttcctgcagagctatggttgtgaaggatacagaatgagggatgaaaatggttgtgtgttaatttgctgggaggatcggccaatgtattcaatatcagcttggagatctaggaagtaa

SEQ ID NO: 212 - protein, 455 aa, Glycine max
  G3810 polypeptide  Orthologous to G922
MMSLSPSLGSPNNLLFREMKSEERGLYLIHLLLTCANHVAAGNLENANTTLEQISMLASPDGDTMQRIATYFMESLADRILKTWPGIHRALNSTRMTLISDEILVQKLFFELFPFLKVAFVLTNQAIIEAMEGEKVIHIIDLNAAEAAQWIALLRVLSAHPEGPPHLRITGVHQKKEILDEVAHRLTEEAEKLDIPFQFNPVASKLENLDFDKLRVKTGEALAISSILQLHTLLAWDDEAMQRKSPLLLKSSNGIHLQRVLPMGQSTLGDLLEKDMVNGYTPSPDSTSSSPSSLTTSNSRPRGRFLNALWGLSPKVMVVTEQDCNHNGPTLMDRLLEALYSYAALFDCLESTVSRTSLERLRVEKMLFGEEIKNIIACEGSERKERHEKLEKWFQRFDLAGFGNVPLSYFGMVQARRFLQSYGCEGYRMRDENGCVLICWEDRPMYSISAWRSRK

SEQ ID NO: 213 - DNA, 1563 bp, Glycine max
  G3811 Predicted polypeptide sequence is orthologous to G922
gaattcggctcgaggttatcttctgtaacttcttcacctcttcagttcttttccatgatgtctctgtcagtttcacctagcttaggatctccctaccatatgaaatgcgagcttaggggtttggtattaatccatttgttgctcgctggtgctaattttgtagccaccggtgatttacaatatgcatacctcacacttgagcagatttcccagcatgcctctcttgatggggatactatgcagcgaattgcttcttatgtttctgaagcactcgctgatcggatacttaaaacatggcctggcatccacagggccctcaattccagcagaataactatggtttctgatgaaattcttgttcaaaagctcttctttgagcttttacccttcctcaagttctcatatatcctcactaatcaggctattgttgaagccatggaaggggagaaaatggtgcatatagttgatctctatggggccggaccggcacagtggatttctctcctccaagttttgagtgcacgtcctgaaggtcctccccatttgagaatcaccggggtccatcacaagaaagaggttctggatcagatggctcataaactcactgaagaggcggaaaagttggatatcccattccaattcaaccctgtgctaagcaagttggaaaatcttgatttcaacaaacttcgcgttaaaactggggaggcactggcaataagttctattatgcagttgcactcccttttggccttggatgaagatgcctcgcggagaaaatcgcctcttttgtcaaaaaactcaaatgcaattcacctgcagaaaggcctcctcatgaaccataacacactgggagatttgcttgacggctatagcccgagtcctgattcggcctcatcctcaccagcagcgtcttcatctgctttgatgaattcggagagctttcttaatgccttgtgggggttatccccaaaagtcatggttgtaactgaacaagactttaaccacaactgtttgaccatgatggagagactggcagaagctctattttcttatgctgcatattttgattgcttggagtccacggtctcaagagcatccatggacagattaaaacttgagaagatgctttttggcgaggagataaagaacatcatagcttgtgaaggatgtgaaagaaaagaaaggcacgaaaagatggataggtggatccagagacttgacttatctggatttgcaaacgtgcctataagctattatgggatgctgcagggaaggaggttcttgcagacctatggttgtgaggggtacaagatgagggaggaatgtggtcgggtgatgatatgctggcaggagcgatccttgttttccataacagcttggagaccaaggaagtaagataaagaagaaaattagtcatgtagtaatggatagagtctctttttttaagtttttcttttcttttctttgtttctaattgtatgacagagttttaccaatgtggtaatgactagtaatgaagagatacttctatttccttaaaaaaaaaaaaaaaagggcggccgc

SEQ ID NO: 214 - protein, 446 aa, Glycine max
  G3811 polypeptide  Orthologous to G922
MMSLSVSPSLGSPYHMKCELRGLVLIHLLLAGANFVATGDLQYAYLTLEQISQHASLDGDTMQRIASYVSEALADRILKTWPGIHRALNSSRITMVSDEILVQKLFFELLPFLKFSYILTNQAIVEAMEGEKMVHIVDLYGAGPAQWISLLQVLSARPEGPPHLRITGVHHKKEVLDQMAHKLTEEAEKLDIPFQFNPVLSKLENLDFNKLRVKTGEALAISSIMQLHSLLALDEDASRRKSPLLSKNSNAIHLQKGLLMNHNTLGDLLDGYSPSPDSASSSPAASSSALMNSESFLNALWGLSPKVMVVTEQDFNHNCLTMMERLAEALFSYAAYFDCLESTVSRASMDRLKLEKMLFGEEIKNIIACEGCERKERHEKMDRWIQRLDLSGFANVPISYYGMLQGRRFLQTYGCEGYKMREECGRVMICWQERSLFSITAWRPRK

SEQ ID NO: 215 - DNA, 1329 bp, Oryza sativa (japonica cultivar-group)
  G3813 Predicted polypeptide sequence is orthologous to G922
atggtccaggacgaaggctcgtcgtcgtcggtgacatcctccccgctccacaacttctccaacatgccgctccacccggccgcggcggcgtcgcccacgccgccatggatggtgcgggagctgcgttccgacgagcgcgggctgtgcctcatccatctcctgctcaactgcgccgcggcggcggcggccgggcggcttgatgctgcgaacgccgcgctcgagcacatcgcgtcgctggcggcgcccgacggggacgccatgcagcgcgtggcggccgccttcgcggaggcgctggcgcggcgcgcgctgagggcgtggcctgggctgtgccgcgcgctgctcctgccccgcgcgtcgcccacgccggccgaggtcgctgccgcgcgccgccacttcctcgacctctgcccgttcctccgcctcgccggcgccgccgccaaccagtcgatactggaggccatggagtccgagaagatcgtgcacgtcatcgacctcggcggcgccgacgccacgcaatggctggagctcctccacctcctcgccgcgcgccccgagggcccgccgcacctgcgcctcacgtcggtgcacgagcacaaggaactcctcacccagacagccatggcgctcacgaaagaagcagagcgcctcgacgtgccgttccagttcaacccggtggtgtcccgcctcgacgccctcgacgtggagtccctccgcgtgaagaccggcgaggccctcgccatctgctccagcctccagctgcactgcctcctggcgtccgacgacgacgccgccgccgtggcgggcggcgacaaggagaggcggagcccggagtccgggctgtcgccgtcgacgtcgcgcgcggacgcgttcctgggcgcgctgtgggggctgtcgccgaaggtgatggtggtggcggagcaggaggcgagccacaacgcggcggggctgacggagaggttcgtggaggcgctcaactactacgcggcgctgttcgactgcctggaggtgggggcggcgcgcgggtcggtggagcgcgcgcgcgtggagcggtggctgctcggggaggagatcaagaacatcgtggcgtgcgacggcggcgagcggcgggagcggcacgagcggctggagcggtgggcgcggcggctggagggcgccggcttcggccgcgtcccgctcagctactacgcgctgctccaggcgcggcgggtggcgcagggcctcggctgcgacggcttcaaggtccgggaggagaagggcaacttcttcctctgctggcaagatcgcgccctcttctccgtctccgcatggcgcggccgccgcttcgactga

SEQ ID NO: 216 - protein, 442 aa, Oryza sativa (japonica cultivar-group)
  G3813 polypeptide  Orthologous to G922
MVQDEGSSSSVTSSPLHNFSNMPLHPAAAASPTPPWMVRELRSDERGLCLIHLLLNCAAAAAAGRLDAANAALEHIASLAAPDGDAMQRVAAAFAEALARRALRAWPGLCRALLLPRASPTPAEVAAARRHFLDLCPFLRLAGAAANQSILEAMESEKIVHVIDLGGADATQWLELLHLLAARPEGPPHLRLTSVHEHKELLTQTAMALTKEAERLDVPFQFNPVVSRLDALDVESLRVKTGEALAICSSLQLHCLLASDDDAAAVAGGDKERRSPESGLSPSTSRADAFLGALWGLSPKVMVVAEQEASHNAAGLTERFVEALNYYAALFDCLEVGAARGSVERARVERWLLGEEIKNIVACDGGERRERHERLERWARRLEGAGFGRVPLSYYALLQARRVAQGLGCDGFKVREEKGNFFLCWQDRALFSVSAWRGRRFD

SEQ ID NO: 217 - DNA, 1554 bp, Oryza sativa (japonica cultivar-group)
  G3814 Predicted polypeptide sequence is orthologous to G922
atgttccaggacgacatgctgtcgtcggcgacgtcatcgccggcgtcgtcggtgtactcgccgtcgccgtcgccgtcgaacgggtcgtgggtgcaggagctgagccatgaccagcagagcgttcggctgatcggcctgctttaccagtgcgccgccgaggtgtccgccggctccttcgaccgcgccaacctctgcctcgagcacatcacgcagctcgcgtccctggacgcgccgcacgcgctccagcgcctcgccgccgtcttcgccgacgcgctcgcgcgcaagctgctcaacctcatcctgggcctctcgcgcgcgctgctgtcgtcggccaactccgccgacgcccacctcgtccccgtcgcgcgccgccacatgttcgacgtgctcccgttcctgaagctcgcgtacctgaccaccaaccatgccatccttgaggcaatggagggggagaggttcgtccacgtcgtcgacttctccggcccggcggcgaacccggtgcagtggatcgcgctgttccacgcgttccgaggccgccgggaaggcccgccgcacctccgcatcaccgccgtccacgacagcaaggagttcctcgcgaacatggccgcggtgctgtccaaggaggcggaggcgttcgacatcgcgttccagttcaacgccgtggaggcgaagctcgacgagatggacttcgacgcgctccgccacgacctcggcgtcaggtccggcgaggcgctcgccgtcagcgtcgtgctgcagcttcaccgcctcctcgccgtcgacgacgggaggaggcacgccgccgccggctgcctcaccccggtccagatcatcgcgcgctccagcccgagaagcttcggcgagctgctggagcgggagctgaacacgcggctgcagctgagccccgacgcgtccgtggtgtcgtcgctgtcaccccactcccccgcagcagcaacggcggcgcacccgacgacgtcgacgccaaagctggggagcttcctgtcggcggtgaggtcgctgtccccgaagatcatggtgatgacggagcaggaggcgaaccacaacggcggcgcgttccaggagcggttcgacgaggcgctcaactactacgcgtcgctgttcgactgcctgcagcggagcgcggcggcggcggcggagcgcgcgcgcgtggagcgggtgctgctcggggaggagatccgcggcgtggtggcgtgcgagggggcggagcgggtggagcggcacgagcgggcgcggcagtgggcggcgcggatggaggcggccggcatggagcgggtggggctgagctacagcggcgccatggaggcgaggaagctgctgcagagctgcgggtgggcggggccgtacgaggtgaggcacgacgccggcggccatggcttcttcttctgctggcacaagaggccgctctacgccgtcacggcgtggcgcccggcggcgtcgcgacgcggccacactcttcatggccgaagatccgagggaacacgggagtctgtcccttggcctcccagaagtagacgtcggtgtggcagagcgaggtga

SEQ ID NO: 218 - protein, 517 aa, Oryza sativa (japonica cultivar-group)
  G3814 polypeptide  Orthologous to G922
MFQDDMLSSATSSPASSVYSPSPSPSNGSWVQELSHDQQSVRLIGLLYQCAAEVSAGSFDRANLCLEHITQLASLDAPHALQRLAAVFADALARKLLNLILGLSRALLSSANSADAHLVPVARRHMFDVLPFLKLAYLTTNHAILEAMEGERFVHVVDFSGPAANPVQWIALFHAFRGRREGPPHLRITAVHDSKEFLANMAAVLSKEAEAFDIAFQFNAVEAKLDEMDFDALRHDLGVRSGEALAVSVVLQLHRLLAVDDGRRHAAAGCLTPVQIIARSSPRSFGELLERELNTRLQLSPDASVVSSLSPHSPAAATAAHPTTSTPKLGSFLSAVRSLSPKIMVMTEQEANHNGGAFQERFDEALNYYASLFDCLQRSAAAAAERARVERVLLGEEIRGVVACEGAERVERHERARQWAARMEAAGMERVGLSYSGAMEARKLLQSCGWAGPYEVRHDAGGHGFFFCWHKRPLYAVTAWRPAASRRGHTLHGRRSEGTRESVPWPPRSRRRCGRAR

SEQ ID NO: 219 - DNA, 1401 bp, Lycopersicon esculentum
  G3824 Predicted polypeptide sequence is orthologous to G922
tggagataccatgcaaaggattgcttcatattttactgaggctttagctgataggattctaaggagttggcctggtctttataaggcgttgcgttcgactaagttatcggttgtctcagaagaaattcttgttaggaagatgtttttcgagatctttcctttcttgaaggtggcgtttgtggtcacaaatcaagctataattgaagctatggaaggtgaaaagatggttcatattgtggatcttaatgctgctgaacccctgcaatggcgtgcgttgcttcaggacttgagcgcgcgtcctgaaggaccgccccatctgcgcattactggggttcatcagcaaaaagaggtgttagatcaaatggcacatgtgcttactcaagaagcagaaaaactggatatcccttttcagttcaatcaagtagttagcagattggaaaatcttgatgttgagaaacttcgcgtgaaaacgggggaggctcttgcgattagttcaattatgcaattgcacacccttctagcccatgataatgacaagaagtcccctttgccttttaagcattcaaatggtgttaacttaaacagggcactagtcaaccaaaatactttaggggaatttcttgaaaaagatatggctaatggttgcagtccaagcaatgacaccgcttcttcatccccgctatgttcaactggttcaacaaagatggatagtttcctcaatgctttgtggggtttatcaccaaaagttatggtggtaacagaacaagatgctaaccataatgggacaactcttatggagaggctatcagagtcgttacatttttatgctgcattatttgattgtcttgaatcgacgctgccaagaacatcattagagagattaaaggtggaaaagatgttattaggtgaagagattagaaacattatagcatgtgaagggatcgaacgaaaggagaggcatgaaaagctcgaaaagtggttccaaagattcgacacatctggttttgggaatgtgcctttgagttattatgctatgttgcaggcaagaaggttgttgcagagttacagttgtgaaggatacaagatcaaagaagataatggttgcgtggtgatatgctggcaggatcgcccacttttctcagtgtcgtcttggcgatgtaggaagtgagactaaacttagttttcattgtaatgttttagatttgtatcttccttttgttgttgtaacataatgtgtagaactccagttggtgaaactgctattgacatgtttgagacattttgtcaacttttttgatctcatgtgataagcttctctctagtgtttagatttccattttgatatggatcaataaagctgatgttctcttaaaaaaaaaaaaaaaaaactcgagactagga

SEQ ID NO: 220 - protein, 385 aa, Lycopersicon esculentum
  G3824 polypeptide  Orthologous to G922
MQRIASYFTEALADRILRSWPGLYKALRSTKLSVVSEEILVRKMFFEIFPFLKVAFVVTNQAIIEAMEGEKMVHIVDLNAAEPLQWRALLQDLSARPEGPPHLRITGVHQQKEVLDQMAHVLTQEAEKLDIPFQFNQVVSRLENLDVEKLRVKTGEALAISSIMQLHTLLAHDNDKKSPLPFKHSNGVNLNRALVNQNTLGEFLEKDMANGCSPSNDTASSSPLCSTGSTKMDSFLNALWGLSPKVMVVTEQDANHNGTTLMERLSESLHFYAALFDCLESTLPRTSLERLKVEKMLLGEEIRNIIACEGIERKERHEKLEKWFQRFDTSGFGNVPLSYYAMLQARRLLQSYSCEGYKIKEDNGCVVICWQDRPLFSVSSWRCRK

SEQ ID NO: 221 - DNA, 1269 bp, Oryza sativa (japonica cultivar-group)
  G3827 Predicted polypeptide sequence is orthologous to G922
atgatcacgtttgggttgaactcccgcccccatccggagttccggaacgacctccgcccatcgtcatcgtcacttgccgccggcgaaagtgagtccccaaaggcggtggagaggctggagagagagggatgtaccagatctggaagctcccgccgtcagccgcgccgaggtgcggcagccgctctggccgtagccagcgccccttcactcgcgagttgttgtcgtcgcccctccatccgcaagctgctgtcgttgccgctccacgctcgcccggtgccgccgccaggctccgggatgcggcagccgctccgcccgtcgccggcggccctccacccacgaggtgctgccgtcgcccctacgcgctcgcctggtgccgccgtcgccggcgctgagatgcggcagcaggtgagctactgctggcgccctgtccgcccgccaccggcgggtggggaggaggctggcggggagctcctcctgcgcggccgcgagctcctgctgctgcagctgctgctaatttatctcgtgtgggacggagggacgctgctcctccttgagctgagcattttcttccttctcttttgttcacttgtgacggccatggcgctcacgaaagaagcagagcgcctcgacgtgcccttccagttcaacccggtggtgtcccgcctcgatgccctcgatgtggagtccctccgcgggctgtcactgaaggtgatggtggtgacggagcaggaggtgagccacaacgcggcggggctgacggagcggttcgtggaggctctcaactactacgcggcgttgttcgactgcctggaggtgggcggggcgcgcgggtcggtggagcgcacgcgcgtggagcggtggctactcggggaggagatcaagaacatcgtggcgtgtgacggcggcgagcggcgggagcggcacgagcggctggagggcgccggctttggccgcgtcccgctcagctactacgcgctgcttcaggccaggcgggtggcgcagggtctcggctgcgacggcttcaaggtccgggaggagaagggcaacttcttcctctgctggcaagatcgcgccctcttctccgtctccgcatggcgcggccgccgcttcgccgccttgctccccttgccgccatcgacgcctctcccctgctcccgcgtcattgctaccttgctctcctccccgccgccgccttgctctcctctccatccgtactgcccagagcggagagagaggatgaagggagagaagaagggaaagagagagtag

SEQ ID NO: 222 - protein, 422 aa, Oryza sativa (japonica cultivar-group)
  G3827 polypeptide  Orthologous to G922
MITFGLNSRPHPEFRNDLRPSSSSLAAGESESPKAVERLEREGCTRSGSSRRQPRRGAAAALAVASAPSLASCCRRPSIRKLLSLPLHARPVPPPGSGMRQPLRPSPAALHPRGAAVAPTRSPGAAVAGAEMRQQVSYCWRPVRPPPAGGEEAGGELLLRGRELLLLQLLLIYLVWDGGTLLLLELSIFFLLFCSLVTAMALTKEAERLDVPFQFNPVVSRLDALDVESLRGLSLKVMVVTEQEVSHNAAGLTERFVEALNYYAALFDCLEVGGARGSVERTRVERWLLGEEIKNIVACDGGERRERHERLEGAGFGRVPLSYYALLQARRVAQGLGCDGFKVREEKGNFFLCWQDRALFSVSAWRGRRFAALLPLPPSTPLPCSRVIATLLSSPPPPCSPLHPYCPERRERMKGEKKGKRE

SEQ ID NO: 223 - DNA, 2217 bp, Arabidopsis thaliana
  misc_feature (2192)..(2192): n is a, c, g, or t
  G175 reference sequence; predicted polypeptide sequence is paralogous to G1274
atttctaaaaatagttaaactgttggtgatttttgtggaactgattaattaacacaattggagaaaacaaattgaaacttttttgtttgttagagagttaaggagaaattttatctaaccaagctgtgtaaatctcttgtagtttttctgccgatatacattttcattgtgttgagggtaaacgataatcaagaacgagagagagagagagcaagagcaagagatttctactacagaagatttattatattgatcattttgtgtgatcaacccataaaaacagagagacatagacaagtccatgtttcgatgtttcgatctctcttactgtctaaacggcgaaataaaaagtctgatgggtgtcacttattgcatgtatattagtaaatcagcttgagcccaagttaaagctgaaacttgggtttgcaatggctggtattgataataaagctgctgtaatgggagaatggttcgactgtagtactactaaccacaggaagagatcgaaagcggaacttggtagagagttttctttaaattacatcaagaatgaggattctttgcaaaccacctttcaagaaagttcacgaggagctcttcgtgaaaggattgctgcgagatccgggtttaatgcaccgtggttaaacactgaggatattcttcagtcgaaatctttaaccatctcttctcctggtcttagtcctgcaactctgttagagtctcctgttttcctctcaaaccctttgctatctccaacaaccgggaagctctcatcagtaccttctgataaggctaaagctgagttatttgacgacattaccacatccttagccttccaaaccatttcaggaagtggccttgatcctactaacatcgctttagaacccgatgattcccaagactatgaagaaagacagctcggcggtttaggagactcgatggcttgttgtgcacctgcagatgatggatacaactggagaaaatatggacaaaagctagttaaaggaagtgagtatccgcggagctattacaagtgcacgcacccgaattgtgaggccaagaagaaggttgaacggtctcgggaaggtcatattatagagatcatatacacaggagatcatatacacagcaaacctccacctaaccgccggtcagggattggatcatccggtactggccaagacatgcaaatagatgcaaccgaatacgaaggttttgctggaaccaatgagaacatagaatggacatcacctgtatctgcagagctcgaatacggaagccattcaggatcaatgcaggttcaaaacgggactcatcagttcgggtatggtgatgcagcagctgatgccttatatagagatgaaaacgaagatgatcgcacgtcccacatgagtgtttccctgacttacgatggagaggtagaagagtccgaatcaaagagaaggaaactagaagcttatgcaacagaaacgagtggatcaaccagagccagccgtgagccaagagttgtggtgcagaccacaagtgacattgacatcctcgatgatggttatcgctggcgcaagtatgggcaaaaagtcgttaaaggaaacccgaatccaaggagctactataaatgcacagctaatggatgtaccgtaacgaagcatgtagagagagcctctgatgacttcaagagcgtactaacaacttatataggcaagcacacccacgttgtaccagcagcacgcaacagcagccacgtcggtgcaggcagttcagggactctccaaggcagtttagcgactcagacccacaaccacaatgtgcactatccaatgccacacagtagatctgagggactggccacagccaactcatctctatttgacttccagtcacacctgaggcatcctacaggtttctccgtttacataggccaatctgagctttctgatctttcaatgcctggtctaactattgggcaagagaagcttaccagcctgcaggcgcctgacattggggatccaactggcctaatgttgcagttagcagcacagccgaaggtggaaccagtgtcaccacaacagggacttgatttgtcagcgagctcattgatatgcagagagatgttgagtagattacgacagatatgaaacaaatctctttgttcactgattgctcaaatttttgaataaatgaaaaattgaganaaaaaaaaaaaaaaaaaaaaaaaaa

SEQ ID NO: 224 - protein, 568 aa, Arabidopsis thaliana
  G175 polypeptide reference sequence; paralogous to G1274
MAGIDNKAAVMGEWFDCSTTNHRKRSKAELGREFSLNYIKNEDSLQTTFQESSRGALRERIAARSGFNAPWLNTEDILQSKSLTISSPGLSPATLLESPVFLSNPLLSPTTGKLSSVPSDKAKAELFDDITTSLAFQTISGSGLDPTNIALEPDDSQDYEERQLGGLGDSMACCAPADDGYNWRKYGQKLVKGSEYPRSYYKCTHPNCEAKKKVERSREGHIIEIIYTGDHIHSKPPPNRRSGIGSSGTGQDMQIDATEYEGFAGTNENIEWTSPVSAELEYGSHSGSMQVQNGTHQFGYGDAAADALYRDENEDDRTSHMSVSLTYDGEVEESESKRRKLEAYATETSGSTRASREPRVVVQTTSDIDILDDGYRWRKYGQKVVKGNPNPRSYYKCTANGCTVTKHVERASDDFKSVLTTYIGKHTHVVPAARNSSHVGAGSSGTLQGSLATQTHNHNVHYPMPHSRSEGLATANSSLFDFQSHLRHPTGFSVYIGQSELSDLSMPGLTIGQEKLTSLQAPDIGDPTGLMLQLAAQPKVEPVSPQQGLDLSASSLICREMLSRLRQI

SEQ ID NO: 225 - DNA, 1072 bp, Arabidopsis thaliana
  G303 reference sequence
aaaagataacgtagccattaacttttatgcattaactccttcatttctttttgtgctcgtttggttgagagagagagaggctatatatgatgttccaacaagattaccctcatggcttttcactcgtggaaacatccttaagttacgaaatgttggattactttcaaaacatcgtcgtttcgaactctgaagacgtggcgtcacagcaaaattccatttcgtcctcttcttattcatcagcgacactctcctgctccataacagagcaaaaatctcacttaactgaaaagttatctcctctacgagaaagatatggttgcggtgactttctgtcgcggaagaggagaaggagaagtgaaaaaacgattgtagataaagagaatcaaaggatgaatcacattgccgtcgagcgtaaccggagaaaacagatgaatcattttctgtctatcctcaagtctatgatgcctctctcttattctcaacctaatgaccaagcatcaatcatagaagggaccattagctatctgaagaagctagaacaacgtctccaatctctcgaagcccaattaaaagctactaaactcaatcaatcaccaaatatattttccgacttcttcatgttccctcaatactccaccgccactgccactgccaccgccactgcctcctcatcctcctcgagccaccaccatcacaagcgactagaggtggttgctgacgtggaggttacaatggtagaaagacatgccaacattaaagtgttaacgaagacacagccaagattgctcttcaagattatcaatgagtttaactctttaggtttaagtactcttcatctcaacctcacaacttccaaagacatgtctctcttcacttttagcgtcaaggtagaggcagattgtcaattgacgccttctggtaatgaggtcgcaaatacggtgcatgaagtcgttagaagagttcacaaggaacgttgaattttgtttacatactagctaactttgaaattctattttattgtataaacaatctcttatgtgtgtaatttacatatatacaattaattaacatt

SEQ ID NO: 226 - protein, 296 aa, Arabidopsis thaliana
  G303 polypeptide reference sequence
MMFQQDYPHGFSLVETSLSYEMLDYFQNIVVSNSEDVASQQNSISSSSYSSATLSCSITEQKSHLTEKLSPLRERYGCGDFLSRKRRRRSEKTIVDKENQRMNHIAVERNRRKQMNHFLSILKSMMPLSYSQPNDQASIIEGTISYLKKLEQRLQSLEAQLKATKLNQSPNIFSDFFMFPQYSTATATATATASSSSSSHHHHKRLEVVADVEVTMVERHANIKVLTKTQPRLLFKIINEFNSLGLSTLHLNLTTSKDMSLFTFSVKVEADCQLTPSGNEVANTVHEVVRRVHKER

SEQ ID NO: 227 - DNA, 628 bp, Arabidopsis thaliana
  G354 reference sequence
cctagaagtcactaagtcgattcaaaatggttgcgagaagtgaggaaattgtgatagtggaagaagatacgactgcgaaatgtttgatgttgttatcaagagtcggagaatgcggcggcggctgcgggggagatgaacgtgttttccgatgcaagacttgtcttaaagagttctcatcgtttcaagctttgggaggtcatcgtgcaagccacaagaaacttatcaacagtgacaatccatcacttcttggatccttgtccaacaagaaaactaaaacgtctcatccttgtccgatatgtggagtgaagtttccgatgggacaagctcttggtggtcacatgaggagacataggaacgagaaagtctcaggctcgttggttacacgttcttttctaccggagacgacgacggtgacggctttgaagaaatttagtagtgggaagagagtggcttgtttggatttggacttagattcgatggagagtttggtcaattggaagttggagttgggaagaacgatttcttggagttaagtttttgggttgtatacagtttcacatgattttgtaatctttgttgatccaattatcgtaccgatcgatgtgaatattattttgatacaataaaa

SEQ ID NO: 228 - protein, 168 aa, Arabidopsis thaliana
  G354 polypeptide reference sequence
MVARSEEIVIVEEDTTAKCLMLLSRVGECGGGCGGDERVFRCKTCLKEFSSFQALGGHRASHKKLINSDNPSLLGSLSNKKTKTSHPCPICGVKFPMGQALGGHMRRHRNEKVSGSLVTRSFLPETTTVTALKKFSSGKRVACLDLDLDSMESLVNWKLELGRTISWS

SEQ ID NO: 229 - DNA, 869 bp, Arabidopsis thaliana
  G489 reference sequence
tggtagtgaatggatcaacaagaccatggacagtctggagctatgaactatggcacaaacccataccaaaccaacccgatgagcaccactgctgctactgtagcaggaggtgcggcacaaccaggccagctggcgttccaccagatccatcagcagcagcagcagcaacagctggcacagcagcttcaagcattttgggagaaccaattcaaagagattgagaagactaccgatttcaagaaccacagccttccccttgcgagaatcaagaaaatcatgaaagcggatgaagatgtccgtatgatctcggctgaggcgccggtcgtgtttgcaagggcctgtgagatgttcatcctggagctgacactcaggtcgtggaaccacactgaggagaataagaggcggacgttgcagaagaacgatattgctgctgctgtgactagaaccgatatttttgatttccttgtggatattgttccccgggaggatctccgagatgaagtcttgggaagtattccgaggggcactgtcccggaagctgctgctgctggttacccgtatggatacttgcctgcaggaactgctccaataggaaatccgggaatggttatgggtaatcccggtggtgcgtatccacctaatccttatatgggtcaaccaatgtggcaacaacaggcacctgaccaacctgaccaggaaaattagcaagaaactgtgagtcttccagcttcttttaggcctaccttgtagtcttggggttttgtttctgttttcgaataatggtaacctttgtataacttatttcagtatcgtctcagtttggtactatgtcagttttggtattcttatcttattgaagtaaaaatgtg

SEQ ID NO: 230 - protein, 220 aa, Arabidopsis thaliana
  G489 polypeptide reference sequence
MNYGTNPYQTNPMSTTAATVAGGAAQPGQLAFHQIHQQQQQQQLAQQLQAFWENQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGSIPRGTVPEAAAAGYPYGYLPAGTAPIGNPGMVMGNPGGAYPPNPYMGQPMWQQQAPDQPDQEN

SEQ ID NO: 231 - DNA, 798 bp, Arabidopsis thaliana
  G634 reference sequence
atggagcaaggaggaggtggtggtggtaatgaagttgtggaggaagcttcacctattagttcaagacctcctgctaacaacttagaagagcttatgagattctcagccgccgcggatgacggtggattaggaggtggaggtggaggaggaggaggaggaagtgcttcttcttcatcgggaaatcgatggccgagagaagaaactttagctcttcttcggatccgatccgatatggattctacttttcgtgatgctactctcaaagctcctctttgggaacatgtttccaggaagctattggagttaggttacaaacgaagttcaaagaaatgcaaagagaaattcgaaaacgttcagaaatattacaaacgtactaaagaaactcgcggtggtcgtcatgatggtaaagcttacaagttcttctctcagcttgaagctctcaacactactcctcctcctcctccttctcatcctcacgctcatcaaccagaacagaaacaacaacaacaaccacaacaagagatggtcatgagctcggaacaatcatcattaccatcatcatcaagatggccaaaggcagagattctagcgcttataaacctgagaagtggaatggaaccaaggtaccaagataatgtacctaaaggacttctatgggaagagatctcaacttcaatgaagagaatgggatacaacagaaacgctaagagatgtaaagagaaatgggaaaacataaacaaatactacaagaaagttaaagaaagcaacaacagcaactacaacaacaagaatcaatga

SEQ ID NO: 232 - protein, 265 aa, Arabidopsis thaliana
  G634 polypeptide reference sequence
MEQGGGGGGNEVVEEASPISSRPPANNLEELMRFSAAADDGGLGGGGGGGGGGSASSSSGNRWPREETLALLRIRSDMDSTFRDATLKAPLWEHVSRKLLELGYKRSSKKCKEKFENVQKYYKRTKETRGGRHDGKAYKFFSQLEALNTTPPPPPSHPHAHQPEQKQQQQPQQEMVMSSEQSSLPSSSRWPKAEILALINLRSGMEPRYQDNVPKGLLWEEISTSMKRMGYNRNAKRCKEKWENINKYYKKVKESNNSNYNNKNQ

SEQ ID NO: 233 - DNA, 341 bp, Arabidopsis thaliana
  G682 reference sequence
acatggataaccatcgcaggactaagcaacccaagaccaactccatcgttacttcttcttctgaaggaacagaagtgagtagtcttgagtgggaagttgtgaacatgagtcaagaagaagaagatttggtctctcgaatgcataagcttgtcggtgacaggtgggaactgatagctgggaggatcccaggaagaaccgctggagaaattgagaggttttgggtcatgaaaaattgaaaagtgatcaatatatctctatagtttcactgattgtttcgattatattccgttgtattttaaatttaccaactctgttataagaagaaaactttcttaaatccc

SEQ ID NO: 234 - protein, 77 aa, Arabidopsis thaliana
  G682 polypeptide reference sequence
MDNHRRTKQPKTNSIVTSSSEGTEVSSLEWEVVNMSQEEEDLVSRMHKLVGDRWELIAGRIPGRTAGEIERFWVMKN

SEQ ID NO: 235 - DNA, 1797 bp, Arabidopsis thaliana
  G916 reference sequence
aaaaaaaaaaacaatctaagatatctatcaagatcttaagatatctacatttatagagatgtttcgttttccggtaagtcttggaggaggtccacgtgagaatctgaagccatcagatgagcagcatcaacgtgcggtggtgaatgaggttgactttttccgatcagcggagaagagagatagggtttcacgtgaagaacaaaacattatcgccgatgagactcatagggttcatgtcaaaagggagaattcacgtgttgatgatcatgacgatcgttctactgatcacatcaatattggacttaatcttctcactgcgaatacgggaagcgacgagtcaatggtggatgatggattgtctgtggatatggaagagaaacgtacaaagtgtgagaatgcacaacttcgcgaagagctaaagaaggcgagtgaagataatcaaagactaaagcaaatgctaagtcaaacaaccaacaacttcaattccttgcagatgcaacttgttgctgtcatgaggcaacaagaagatcatcatcacctagctacgaccgagaacaatgacaatgtaaagaaccgacatgaagtgcctgaaatggttccaagacagttcatcgatttgggaccgcattctgacgaagtgtcgtccgaggagaggacgacggttcggtcgggatctcctccctcgcttctagagaaatctagctcacgtcaaaacggaaagagagtgcttgtaagagaagaaagcccggaaaccgaatccaacggctggagaaaccctaacaaagttcctaaacaccatgcatcatccagcatttgcggtggcaatggcagtgaaaatgcaagtagcaaggtcattgagcaagcggccgccgaagccaccatgcgtaaagcccgtgtctcggttcgtgctcgatccgaagctcccatgttaagcgatggatgtcaatggagaaaatacggacaaaaaatggcgaaaggaaacccgtgccctcgagcttattaccgttgcacaatggctgttggatgtcctgttcgcaagcaagtgcaacgttgcgcggaagatagaaccattctcataacaacctacgaaggaaaccataaccatccattacctcctgcggctatgaacatggcttcaactacaacagcagccgcaagcatgcttctctcaggctccaccatgtcgaaccaagacggtttaatgaacccaacaaatctcttggctcgaaccatattaccgtgttcctcaagcatggctactatctcagcctctgcaccattcccaaccattacattagacctcacagagtcacccaacgggaacaatccaaccaataacccgctgatgcaattctctcaacggtctggtttggtggagttgaaccaatcggttttgcctcatatgatgggtcaggctttgtactacaaccaacagtctaagttttcgggtttacatatgccgtctcagccgctaaacgctggtgagagtgttagcgccgctactgccgcaatcgcctccaatcccaactttgccgcggctctagctgcagccataacttcgattatcaacggttcgaacaatcagcagaatgggaacaacaataacagtaatgttacaacgagcaacgttgacaataggcaataacatttttttataagttttagttagggactttttatcggtcgattttgttttgtttttcttttattacattattttttagttacggcttttttttgttttttcttttctttcccaaacaacaagtattgagagcaattcccccccccccccct

SEQ ID NO: 236 - protein, 528 aa, Arabidopsis thaliana
  G916 polypeptide reference sequence
MFRFPVSLGGGPRENLKPSDEQHQRAVVNEVDFFRSAEKRDRVSREEQNIIADETHRVHVKRENSRVDDHDDRSTDHINIGLNLLTANTGSDESMVDDGLSVDMEEKRTKCENAQLREELKKASEDNQRLKQMLSQTTNNFNSLQMQLVAVMRQQEDHHHLATTENNDNVKNRHEVPEMVPRQFIDLGPHSDEVSSEERTTVRSGSPPSLLEKSSSRQNGKRVLVREESPETESNGWRNPNKVPKHHASSSICGGNGSENASSKVIEQAAAEATMRKARVSVRARSEAPMLSDGCQWRKYGQKMAKGNPCPRAYYRCTMAVGCPVRKQVQRCAEDRTILITTYEGNHNHPLPPAAMNMASTTTAAASMLLSGSTMSNQDGLMNPTNLLARTILPCSSSMATISASAPFPTITLDLTESPNGNNPTNNPLMQFSQRSGLVELNQSVLPHMMGQALYYNQQSKFSGLHMPSQPLNAGESVSAATAAIASNPNFAAALAAAITSIINGSNNQQNGNNNNSNVTTSNVDNRQ

SEQ ID NO: 237 - DNA, 768 bp, Arabidopsis thaliana
  G975 reference sequence
attactcatcatcaagttcctactttctctctgacaaacatcacagagtaagtaagaatggtacagacgaagaagttcagaggtgtcaggcaacgccattggggttcttgggtcgctgagattcgtcatcctctcttgaaacggaggatttggctagggacgttcgagaccgcagaggaggcagcaagagcatacgacgaggccgccgttttaatgagcggccgcaacgccaaaaccaactttcccctcaacaacaacaacaccggagaaacttccgagggcaaaaccgatatttcagcttcgtccacaatgtcatcctcaacatcatcttcatcgctctcttccatcctcagcgccaaactgaggaaatgctgcaagtctccttccccatccctcacctgcctccgtcttgacacagccagctcccatatcggcgtctggcagaaacgggccggttcaaagtctgactccagctgggtcatgacggtggagctaggtcccgcaagctcctcccaagagactactagtaaagcttcacaagacgctattcttgctccgaccactgaagttgaaattggtggcagcagagaagaagtattggatgaggaagaaaaggttgctttgcaaatgatagaggagcttctcaatacaaactaaatcttatttgcttatatatatgtacctattttcattgctgatttacagccaaaataatcaattataccgtgtattttatagatgttttatattaaaaggttgttagatata

SEQ ID NO: 238 - protein, 199 aa, Arabidopsis thaliana
  G975 polypeptide reference sequence
MVQTKKFRGVRQRHWGSWVAEIRHPLLKRRIWLGTFETAEEAARAYDEAAVLMSGRNAKTNFPLNNNNTGETSEGKTDISASSTMSSSTSSSSLSSILSAKLRKCCKSPSPSLTCLRLDTASSHIGVWQKRAGSKSDSSWVMTVELGPASSSQETTSKASQDAILAPTTEVEIGGSREEVLDEEEKVALQMIEELLNTN

SEQ ID NO: 239 - DNA, 1116 bp, Arabidopsis thaliana
  G1069 Reference sequence; functionally related, homologous to G1073
ttggaaccctagaggcctttcaagcaaatcatcagggtaacaatttcttgatctttctttttagcgaatttccagtttttggtcaatcatggcaaacccttggtggacgaaccagagtggtttagcgggcatggtggaccattcggtctcctcaggccatcaccaaaaccatcaccaccaaagtcttcttaccaaaggagatcttggaatagccatgaatcagagccaagacaacgaccaagacgaagaagatgatcctagagaaggagccgttgaggtggtcaaccgtagaccaagaggtagaccaccaggatccaaaaacaaacccaaagctccaatctttgtgacaagagacagccccaacgcactccgtagccatgtcttggagatctccgacggcagtgacgtcgccgacacaatcgctcacttctcaagacgcaggcaacgcggcgtttgcgttctcagcgggacaggctcagtcgctaacgtcaccctccgccaagccgccgcaccaggaggtgtggtctctctccaaggcaggtttgaaatcttatctttaaccggtgctttcctccctggaccttccccacccgggtcaaccggtttaacggtttacttagccggggtccagggtcaggtcgttggaggtagcgttgtaggcccactcttagccatagggtcggtcatggtgattgctgctactttctctaacgctacttatgagagattgcccatggaagaagaggaagacggtggcggctcaagacagattcacggaggcggtgactcaccgcccagaatcggtagtaacctgcctgatctatcagggatggccgggccaggctacaatatgccgccgcatctgattccaaatggggctggtcagctagggcacgaaccatatacatgggtccacgcaagaccaccttactgactcagtgagccatttctatatataatggtctatataaataaatatatagatgaatataagcaagcaatttgaggtagtctattacaaagcttttgctctggttggaaaaataaataagtatcaaagctttgtttgttcttaatggaaatatagagcttgggaaggtagaaagagacgacatt

SEQ ID NO: 240 - protein, 281 aa, Arabidopsis thaliana
  G1069 Reference sequence; functionally related, homologous to G1073
MANPWWTNQSGLAGMVDHSVSSGHHQNHHHQSLLTKGDLGIAMNQSQDNDQDEEDDPREGAVEVVNRRPRGRPPGSKNKPKAPIFVTRDSPNALRSHVLEISDGSDVADTIAHFSRRRQRGVCVLSGTGSVANVTLRQAAAPGGVVSLQGRFEILSLTGAFLPGPSPPGSTGLTVYLAGVQGQVVGGSVVGPLLAIGSVMVIAATFSNATYERLPMEEEEDGGGSRQIHGGGDSPPRIGSNLPDLSGMAGPGYNMPPHLIPNGAGQLGHEPYTWVHARPPY

SEQ ID NO: 241 - DNA, 1371 bp, Arabidopsis thaliana
  G1452 Reference sequence; functionally related, homologous to G512
atttattaagcatcaatgagagaacttcagagctgggtttgagttctgtccaataatacataaccacgttatcatttttgtcctttactatctcattacactcttctgttattcgcccaattcttacagtcattactctctatagggctcgagcggccgcccgggcaggtttctatgcagatggttcacacttcccgctccattgcccagattgggttcggtgttaagtcgcaattagtactcactatagggctcgagcggccgcccgggcaggtaaaagatcaaacaatgtctaaagaagctgagatgtcgatcgcggtgtcggctttgttccctggttttagattctctcctactgatgttgaacttatctcgtactatcttcgtcgtaaaatcgatggtgatgagaactctgttgctgtgattgctgaggtcgagatttacaagttcgagccgtgggacttgccagaggaatcgaaactgaaatcggagaacgagtggttttacttctgcgcgagggggaggaagtacccgcacgggtcacaaagccggcgagccacacagctaggatattggaaagcgaccggtaaagagcggagtgttaaatccgggaaccaagttgttggaaccaagagaacgcttgtatttcatatcggtcgggctcctcgtggcgagagaacggagtggattatgcatgaatactgcatccatggagccccacaggatgcattagtggtgtgccggttaagaaaaaatgctgattttcgggctagttcgacccaaaaaattgaggatggtgttgtgcaagacgatggctacgttggccaaagaggtggtttggacaaggaggacaaatcctactatgaatctgagcatcagataccaaatggtgacatcgcagaatcatcaaatgttgttgaggatcaggccgataccgatgatgattgttacgccgagattctgaacgatgatataataaagctcgacgaagaagcgttgaaagctagccaagcgtttcgaccaactaatccaactcatcaagaaacaatatcaagcgagtcatcgagtaagaggtcaaaatgtggtataaaaaaagaatcaacggaaacaatgaattgttacgctttgttcaggatcaagaacgttgccggaaccgactccagctggagattcccgaacccgttcaaaatcaagaaagatgatagccagagattgatgaagaatgttctggccactactgttttcttggctatcttattttctttcttttggactgtattaatagctaggaactaaagctagttacgacatacatattatttatacataaataaatatagtattttgtctatggcaaaaaaaaaaaaaaaa

SEQ ID NO: 242 - protein, 373 aa, Arabidopsis thaliana
  G1452 polypeptide Reference sequence; functionally related, homologous to G512
MQMVHTSRSIAQIGFGVKSQLVLTIGLERPPGQVKDQTMSKEAEMSIAVSALFPGFRFSPTDVELISYYLRRKIDGDENSVAVIAEVEIYKFEPWDLPEESKLKSENEWFYFCARGRKYPHGSQSRRATQLGYWKATGKERSVKSGNQVVGTKRTLVFHIGRAPRGERTEWIMHEYCIHGAPQDALVVCRLRKNADFRASSTQKIEDGVVQDDGYVGQRGGLDKEDKSYYESEHQIPNGDIAESSNVVEDQADTDDDCYAEILNDDIIKLDEEALKASQAFRPTNPTHQETISSESSSKRSKCGIKKESTETMNCYALFRIKNVAGTDSSWRFPNPFKIKKDDSQRLMKNVLATTVFLAILFSFFWTVLIARN

SEQ ID NO: 243 - DNA, 732 bp, Arabidopsis thaliana
  G1820 Reference sequence
ctcacttccaacatccaaatccctagaaattgtaaatggctgagaacaacaacaacaacggcgacaacatgaacaacgacaaccaccagcaaccaccgtcgtactcgcagctgccgccgatggcatcatccaaccctcagttacgtaattactggattgagcagatggaaaccgtctcggatttcaaaaaccgtcagcttccattggctcgaattaagaagatcatgaaggctgatccagatgtgcacatggtctccgcagaggctccgatcatcttcgcaaaggcttgcgaaatgttcatcgttgatctcacgatgcggtcgtggctcaaagccgaggagaacaaacgccacacgcttcagaaatcggatatctccaacgcagtggctagctctttcacctacgatttccttcttgatgttgtccctaaggacgagtctatcgccaccgctgatcctggctttgtggctatgccacatcctgacggtggaggagtaccgcaatattattatccaccgggagtggtgatgggaactcctatggttggtagtggaatgtacgcgccatcgcaggcgtggccagcagcggctggtgacggggaggatgatgctgaggataatggaggaaacggcggcggaaattgaagtgtagatttagggtttgtaaccgcctatgtgggaaatttgaaatttggtggtgtttattagggttcttcaattcgtcggatttgct

SEQ ID NO: 244 - protein, 202 aa, Arabidopsis thaliana
  G1820 polypeptide Reference sequence
MAENNNNNGDNMNNDNHQQPPSYSQLPPMASSNPQLRNYWIEQMETVSDFKNRQLPLARIKKIMKADPDVHMVSAEAPIIFAKACEMFIVDLTMRSWLKAEENKRHTLQKSDISNAVASSFTYDFLLDVVPKDESIATADPGFVAMPHPDGGGVPQYYYPPGVVMGTPMVGSGMYAPSQAWPAAAGDGEDDAEDNGGNGGGN

SEQ ID NO: 245 - DNA, 866 bp, Arabidopsis thaliana
  G2701 reference sequence; predicted polypeptide sequence is paralogous to G1634
gtgtttgtagttgaaacttattcttccctttttttgtttttaggtatggagactctgcatccattctctcacctacctatctctgaccaccggttcgttgttcaagagatggtgagcttacacagctcgagtagcggtagctggactaaagaagagaacaagatgttcgaacgagctcttgcgatatacgctgaagactcgcctgatcgctggtttaaagttgcttccatgatccctggaaagactgtttttgatgttatgaagcaatatagtaagcttgaagaagacgttttcgatattgaagcaggacgtgttcccattcctggttatcctgcagcttcttctcccttggggtttgacacggacatgtgtcgtaaacggcctagtggagctagaggatctgatcaagatcgaaagaaaggagtcccttggacagaggaagaacacaggagattcttgttaggccttctcaagtacggtaaaggagattggagaaacatatcgagaaacttcgtggtgtcaaagacgccaacgcaagtggcgagccacgcccaaaagtattaccagagacagctctccggagccaaggacaaacgcaggccaagtatccatgacatcacaaccggcaatcttctcaatgccaatctcaaccgttccttttccgatcatagagatattctccctgatttagggtttatcgataaggatgatacggaggagggagtaatatttatgggtcagaatctctcttcagaaaatctgttttctccatcaccaacttcattcgaagctgccattaacttcgccggagaaaatgtcttcagtgccggagcttaaggcaacatagaatccccaaactcagcggc

SEQ ID NO: 246 - protein, 263 aa, Arabidopsis thaliana
  G2701 polypeptide reference sequence; paralogous to G1634
METLHPFSHLPISDHRFVVQEMVSLHSSSSGSWTKEENKMFERALAIYAEDSPDRWFKVASMIPGKTVFDVMKQYSKLEEDVFDIEAGRVPIPGYPAASSPLGFDTDMCRKRPSGARGSDQDRKKGVPWTEEEHRRFLLGLLKYGKGDWRNISRNFVVSKTPTQVASHAQKYYQRQLSGAKDKRRPSIHDITTGNLLNANLNRSFSDHRDILPDLGFIDKDDTEEGVIFMGQNLSSENLFSPSPTSFEAAINFAGENVFSAGA

SEQ ID NO: 247 - DNA, 1040 bp, Arabidopsis thaliana
  G2789 Reference sequence; predicted polypeptide sequence is paralogous to G596
ctttagggacaccaaatctattcaacctaaaagccttcttttcccctatattgaccaactttttagcgaatcagaagaggaatggatgaggtatctcgttctcatacaccgcaatttctatcaagtgatcatcagcactatcaccatcaaaacgctggacgacaaaaacgcggcagagaagaagaaggagttgaacccaacaatataggggaagacctagccacctttccttccggagaagagaatatcaagaagagaaggccacgtggcagacctgctggttccaagaacaaacccaaagcaccaatcatagtcactcgcgactccgcgaacgccttcagatgtcacgtcatggagataaccaacgcctgcgatgtaatggaaagcctagccgtcttcgctagacgccgtcagcgtggcgtttgcgtcttgaccggaaacggggccgttacaaacgtcaccgttagacaacctggcggaggcgtcgtcagtttacacggacggtttgagattctttctctctcgggttcgtttcttcctccaccggcaccaccagctgcgtctggtttaaaggtttacttagccggtggtcaaggtcaagtgatcggaggcagtgtggtgggaccgcttacggcatcaagtccggtggtcgttatggcagcttcatttggaaacgcatcttacgagaggctgccactagaggaggaggaggaaactgaaagagaaatagatggaaacgcggctagggcgattggaacgcaaacgcagaaacagttaatgcaagatgcgacatcgtttattgggtcgccgtcgaatttaattaactctgtttcgttgccaggtgaagcttattggggaacgcaacgaccgtctttctaagataatatcattgataatataagtttcgtcttcttattctttttcactttttacctttttcactttcttaggttttgttttaacgtttgattaatacctgaaggtttttggaaaattttcgatcggataaaaggatttatgttgcgagccgaaacgcggcc

SEQ ID NO: 248 - protein, 265 aa, Arabidopsis thaliana
  G2789 polypeptide reference sequence; paralogous to G596
MDEVSRSHTPQFLSSDHQHYHHQNAGRQKRGREEEGVEPNNIGEDLATFPSGEENIKKRRPRGRPAGSKNKPKAPIIVTRDSANAFRCHVMEITNACDVMESLAVFARRRQRGVCVLTGNGAVTNVTVRQPGGGVVSLHGRFEILSLSGSFLPPPAPPAASGLKVYLAGGQGQVIGGSVVGPLTASSPVVVMAASFGNASYERLPLEEEEETEREIDGNAARAIGTQTQKQLMQDATSFIGSPSNLINSVSLPGEAYWGTQRPSF

SEQ ID NO: 249 - DNA, 495 bp, Arabidopsis thaliana
  G2839 Reference sequence; predicted polypeptide sequence is paralogous to G354
atggttgcgagaagtgaggaagttgagatagtggaagatacggcggcgaaatgtttgatgttgttatcaagagttggagaatgcggcggaggaggagagaaacgagttttccgatgcaagacttgtcttaaagagttttcgtcgtttcaagctttgggaggtcatcgtgcaagccacaagaaactcattaacagtagcgatccatcacttcttggatccttgtctaacaagaaaactaaaacggcgacgtctcatccttgtccgatatgtggcgtggagtttccgatggggcaagctcttggtggtcacatgaggagacataggagtgagaaagcctcaccaggcacgttggttacacgttcttttttaccggagacgacgacggtgacgactttgaaaaaatcgagtagtgggaagagagtggcttgtttggacttagattcgatggagagtttagtcaattggaagttggagttgggaagaacgatttcttga

SEQ ID NO: 250 - protein, 164 aa, Arabidopsis thaliana
  G2839 polypeptide reference sequence; paralogous to G354
MVARSEEVEIVEDTAAKCLMLLSRVGECGGGGEKRVFRCKTCLKEFSSFQALGGHRASHKKLINSSDPSLLGSLSNKKTKTATSHPCPICGVEFPMGQALGGHMRRHRSEKASPGTLVTRSFLPETTTVTTLKKSSSGKRVACLDLDSMESLVNWKLELGRTIS

SEQ ID NO: 251 - DNA, 1569 bp, Arabidopsis thaliana
  G2854 Reference sequence; predicted polypeptide sequence is paralogous to G1940
tctctcttttgcccttacgtcctcgagctcaaccctttaattgcatctacgacagtcgtaccttttgctaggttatcgtcgtcatgatgcagcagccacctccagcttccaacggtgctgcaacagggccagggcagattccttccgaccaacaagcttacctccagcagcagcagtcgtggatgatgcagcaccagcagcaacaacaaggtcagccgcctgcaggatggaatcagcagtctgcaccgtcttctggtcaaccacagcagcagcagtatggtggtggtggatctcagaatccaggatcagctggtgagatccggtccctgtggatcggtgacttgcagccatggatggatgagaactatctcatgaacgtctttggtcttactggcgaggctacagcagctaaagttattcgcaataaacagaacggatattcagaaggttatggctttattgagtttgtgaaccatgctacagctgagaggaatttacagacttacaatggtgctccgatgccgagcagtgagcaggccttcaggttgaactgggctcagcttggagctggagagagacgccaggctgaagggcctgagcacacagtttttgttggagacttggcacctgatgttaccgaccacatgcttactgaaacgtttaaagctgtgtattcctctgtcaagggagctaaagttgtgaatgataggactactggacggtccaagggttatggatttgtcaggtttgcggatgaaagtgagcagattcgtgccatgactgaaatgaatggtcaatactgctcatcaaggcctatgcgtactggtcctgctgccaacaagaagcctcttacaatgcaaccagcttcatatcagaacactcaaggaaattcaggagaaagtgatccaactaacacaacaatttttgttggagctgtggatcaaagtgtaacagaagatgatttgaagtcagtttttggtcaatttggtgaactagttcatgtgaaaatacccgcaggaaaacgttgcggatttgttcaatacgccaatagggcatgtgctgagcaagcactttctgtgttgaacggaacacaacttgggggacaaagcattcgtctttcatggggtcgcagtccttccaacaaacagactcaacctgatcaagcccagtatggtggtggtggaggatactatgggtatcctcctcaaggatatgaagcatacggatatgcacctcctcctcaggaccctaacgcctactacggtggttatgctgggggcggctatggaaactaccagcagcctggtggataccagcagcaacagcagtgaagcatgatgtgtaagtcgtgatcgagctgaagttgtagaaagctgtaaccgtttgacaatggtgaatgaattattgaagtggatgtgtattagctcttcttgtctcagattctctcttcaactcttttttttttcttttggattatttttctttcgcgtggctattgttgagtgtccttgcaagtcataacaaaaagcttaaacccaagtgttttttgtcatgactaatatgaccatt

SEQ ID NO: 252 - protein, 415 aa, Arabidopsis thaliana
  G2854 polypeptide  reference sequence; paralogous to G1940
MMQQPPPASNGAATGPGQIPSDQQAYLQQQQSWMMQHQQQQQGQPPAGWNQQSAPSSGQPQQQQYGGGGSQNPGSAGEIRSLWIGDLQPWMDENYLMNVFGLTGEATAAKVIRNKQNGYSEGYGFIEFVNHATAERNLQTYNGAPMPSSEQAFRLNWAQLGAGERRQAEGPEHTVFVGDLAPDVTDHMLTETFKAVYSSVKGAKVVNDRTTGRSKGYGFVRFADESEQIRAMTEMNGQYCSSRPMRTGPAANKKPLTMQPASYQNTQGNSGESDPTNTTIFVGAVDQSVTEDDLKSVFGQFGELVHVKIPAGKRCGFVQYANRACAEQALSVLNGTQLGGQSIRLSWGRSPSNKQTQPDQAQYGGGGGYYGYPPQGYEAYGYAPPPQDPNAYYGGYAGGGYGNYQQPGGYQQQQQ

SEQ ID NO: 253 - DNA, 914 bp, Arabidopsis thaliana
  G3083 reference sequence
caaaatatgagccaagagacagcgatagcaagcttcaagaaattccaacagtcatggatcgagcagctacgaaaccacctgaaccacctccgctccgcccaaaaccatcaccggaactctgctaccggtgatgaggaacggttaagggaggctgtggacagagtgatggaacactttagagaatatcacagggccaagtgggctgcgacggataaagacgtcatcgaagttatggcttctccttgggcttcagctcttgaacggtcgcttcagtgggtcggtggttggcgaccaaccaccttgttccatctggtttacactgagtcgagtattttatttgagtctcgtatcgttgatatacttcgtggctttcgcaccggtgatctcagtgatctctccccttctcagttcaggacggtaagtgagctacaatgtgagaccgtgaaggaagagaatgcgataacggaagagttgtcggagtggcaagacgatgcgagtgaccttgtcatggggacatcgtcagatcccgaccagaggatccgacggctagcagaaatcgtccaccgaactgatgatctgcgactgagaacgatcacacgtgtggtggaggtcttgagtccgctccaacaagcggagtttcttgtcgctgcggctgagcttcgtacaggcgttgctggttgggggactagccacgaccgtcgtcgaagttccgaagtttaaagctaactaaaaccggtctaaaggtaatgagaatcgaggaagaaaaatagtttttggatattaattatatgtttttaccatgtttttggttatccagactgagtttggttttacatggttatgaaaacaaaaaaaactcatatgttatgtctctacggttgcaataaagatcaacccacgtgtggtgcttgtta

SEQ ID NO: 254 - protein, 237 aa, Arabidopsis thaliana
  G3083 polypeptide; reference sequence
MSQETAIASFKKFQQSWIEQLRNHLNHLRSAQNHHRNSATGDEERLREAVDRVMEHFREYHRAKWAATDKDVIEVMASPWASALERSLQWVGGWRPTTLFHLVYTESSILFESRIVDILRGFRTGDLSDLSPSQFRTVSELQCETVKEENAITEELSEWQDDASDLVMGTSSDPDQRIRRLAEIVHRTDDLRLRTITRVVEVLSPLQQAEFLVAAAELRTGVAGWGTSHDRRRSSEV

SEQ ID NO: 255 - DNA, 1974 bp, Arabidopsis thaliana
  G184; predicted polypeptide sequence is paralogous to G916
tgaattctagcctttttgtaggcgaatcatctggaccggtaagagactctctcatcgataataaccacataatttaatcaaactctttctctctctttctaagatcttttgctttgctcttttcctttttgatcttcctatatatggagaagcaccaaaacggtacttactatacgatactgtacggatccatcaaactggattaattatcaaaacgtacatttttatcttacctggcaagttacattcctagggttttggagaatccaatcaacaacaaagaaaataatcatcgttacaataatcagtatcacgcacagacttagatgttccggtttccagtgagtctaggcggttcacgtgacgaagaccgtcacgatcagatcacaccgttggatgaccatcgtgtggtggttgatgaggttgacttcttctcagagaagagagatagggtttcacgtgagaacatcaacgacgacgacgacgaaggcaataaggttctcatcaaaatggagggttcacgagttgaagaaaacgatcgttccagagatgtcaatatcggtctgaatcttctgaccgcgaatacgggaagcgatgagtcaacggtggatgatggactatcaatggatatggaagataaacgtgcaaagattgagaacgcacaactacaagaagagctcaagaagatgaaaatagagaatcaaaggctaagagatatgttgagccaagcgacgaccaacttcaatgccttacaaatgcaacttgttgccgtcatgaggcaacaagaacaacgtaactcttcacaagatcatctcctggagagcaaagcagaaggaaggaaacggcaggaactgcaaatcatggtgccaaggcagttcatggaccttgggccgtcgtctggagcagcagagcatggagccgaagtgtcatctgaagagaggacaacggttcgttcaggttctcctccttcgcttctagaaagttccaatccccgagagaacggaaagaggttgcttggaagagaagaaagctcagaggaatcagagtctaacgcctggggaaaccctaacaaagtccccaaacataatccatcctctagcaatagcaatggaaacagaaacggaaatgttattgatcagtcggccgcagaagccaccatgcggaaagcccgtgtctcagttcgtgcccgatctgaagctgccatgataagcgatggatgtcaatggagaaagtacggacaaaaaatggctaaaggaaacccgtgtccgcgggcttattatcgttgcacaatggccggtggatgtccagttcgcaagcaagtgcagcgttgcgcagaagacagatctattctcataaccacctacgaaggaaaccacaaccatccactcccaccagccgctacggccatggcctcaacaaccaccgcagctgcaagcatgctcctctcgggctcaatgtcgagtcaagacggtttaatgaacccaacaaacctcctagctcgagctatcttgccttgctcctcaagcatggctacaatctcagcctccgcaccattcccaaccatcacattggacctcaccaattcacccaacggtaacaaccctaatatgaccactaataacccgttgatgcagttcgctcaacggcccggtttcaacccggcagttttgcctcaagtggttggtcaagctatgtacaataaccaacaacagtccaagttttctggtttacagttaccggctcagccactgcagatcgcggccacttcctcggtggccgagagcgttagtgctgccagtgcagcaattgcgtccgatccaaactttgcggcggctctagcggcagcgatcacgtccattatgaacggttccagtcatcaaaataataacaccaataataataatgtggctacgagcaacaatgacagtaggcaataagagttttcattttgatggtcgatttttttttttgggg

SEQ ID NO: 256 - protein, 536 aa, Arabidopsis thaliana
  G184 polypeptide; paralogous to G916
MFRFPVSLGGSRDEDRHDQITPLDDHRVVVDEVDFFSEKRDRVSRENINDDDDEGNKVLIKMEGSRVEENDRSRDVNIGLNLLTANTGSDESTVDDGLSMDMEDKRAKIENAQLQEELKKMKIENQRLRDMLSQATTNFNALQMQLVAVMRQQEQRNSSQDHLLESKAEGRKRQELQIMVPRQFMDLGPSSGAAEHGAEVSSEERTTVRSGSPPSLLESSNPRENGKRLLGREESSEESESNAWGNPNKVPKHNPSSSNSNGNRNGNVIDQSAAEATMRKARVSVRARSEAAMISDGCQWRKYGQKMAKGNPCPRAYYRCTMAGGCPVRKQVQRCAEDRSILITTYEGNHNHPLPPAATAMASTTTAAASMLLSGSMSSQDGLMNPTNLLARAILPCSSSMATISASAPFPTITLDLTNSPNGNNPNMTTNNPLMQFAQRPGFNPAVLPQVVGQAMYNNQQQSKFSGLQLPAQPLQIAATSSVAESVSAASAAIASDPNFAAALAAAITSIMNGSSHQNNNTNNNNVATSNNDSRQ

SEQ ID NO: 257 - DNA, 1931 bp, Arabidopsis thaliana
  G186; predicted polypeptide sequence is paralogous to G916
ctttcaaccaaacccctaaacaaaaaaaaaatacattttctgatctctctaaaaatctttctccttcgttaatctcgtgatctctttctttttctatatatggacagaggatggtctggtctcactcttgattcatcttctcttgatcttttaaaccctaatcgtatttctcataagaatcaccgacgtttctcaaatcctttggcgatgtctagaattgacgaagaagatgatcagaagacgagaatatcaaccaacggtagtgaatttaggtttccggtgagtctctcaggtattcgtgatcgtgaagatgaagatttttcatctggcgttgctggagataatgaccgtgaagttcccggcgaagtggatttcttctccgacaagaaatctagggtttgtcgtgaagacgacgaaggatttcgtgtgaagaaggaagaacaagatgatcgaacggacgtaaataccggtttgaatcttcgaacaactggtaatacaaagagtgatgagtcaatgatcgatgatggagaatcttccgaaatggaagataagcgtgcgaaaaatgagttggtgaaattacaagatgagttgaagaaaatgacaatggataatcaaaagcttagagaattgcttacacaagttagcaacagttacacttcacttcagatgcatcttgtttcactaatgcagcaacagcaacaacagaacaataaggtaatagaagctgctgagaagcctgaggagacgatagtaccaaggcaatttattgatttaggccctacgagagcagtaggtgaggccgaggatgtgtcaaattcttcatccgaagatagaactcgttcggggggttcttctgcagccgagaggcgtagtaacgggaagagacttgggcgtgaagaaagccccgaaactgagtccaacaaaattcagaaggtgaattctactaccccgacgacatttgatcaaaccgctgaagctacgatgaggaaagcccgtgtctccgttcgtgcccgatcggaagctccgatgataagcgatggatgtcaatggagaaaatatggccagaagatggccaaagggaatccttgtccgcgggcatattaccgctgcacgatggccacgggctgtcccgttcgcaaacaagttcaacgttgcgcggaagacagatcaattctgattacaacctacgagggaaaccataaccatccgttgccgccagccgcggtagccatggcttctaccaccacggcggcggctaacatgttgctatccgggtcaatgtctagtcacgacgggatgatgaaccctacaaatttactagctagggctgttcttccttgctccacaagcatggcaacaatctcagcctccgcgccgtttccaaccgtcacattagacctcacccactcacctccgcctcctaatggttccaatccttcctcttccgcggctaccaacaacaaccacaactcactgatgcagcggccgcaacaacaacaacagcaaatgacgaacttacctccgggaatgctacctcatgtaataggccaggcattgtataaccaatccaagttctcggggctgcagttctctggtggctctccctcgacggcagcgttttctcagtcacacgcggtggctgatacaataacggcactcacagctgacccgaatttcacggcggctcttgcagccgttatttcttctatgatcaatggtacgaaccaccacgacggcgaaggaaacaacaaaaatcaatagaaaaatattacattttttttttgggtatctacattttttttccaactgggttataggaaacagagagtttatttcattgattcacatttgttctgtttcgtaccaaaatcccagtaaatatacaaaagcaaactatactcaagttcatattcgtaaacactataaatagt

SEQ ID NO: 258 - protein, 553 aa, Arabidopsis thaliana
  G186 polypeptide; paralogous to G916
MDRGWSGLTLDSSSLDLLNPNRISHKNHRRFSNPLAMSRIDEEDDQKTRISTNGSEFRFPVSLSGIRDREDEDFSSGVAGDNDREVPGEVDFFSDKKSRVCREDDEGFRVKKEEQDDRTDVNTGLNLRTTGNTKSDESMIDDGESSEMEDKRAKNELVKLQDELKKMTMDNQKLRELLTQVSNSYTSLQMHLVSLMQQQQQQNNKVIEAAEKPEETIVPRQFIDLGPTRAVGEAEDVSNSSSEDRTRSGGSSAAERRSNGKRLGREESPETESNKIQKVNSTTPTTFDQTAEATMRKARVSVRARSEAPMISDGCQWRKYGQKMAKGNPCPRAYYRCTMATGCPVRKQVQRCAEDRSILITTYEGNHNHPLPPAAVAMASTTTAAANMLLSGSMSSHDGMMNPTNLLARAVLPCSTSMATISASAPFPTVTLDLTHSPPPPNGSNPSSSAATNNNHNSLMQRPQQQQQQMTNLPPGMLPHVIGQALYNQSKFSGLQFSGGSPSTAAFSQSHAVADTITALTADPNFTAALAAVISSMINGTNHHDGEGNNKNQ

SEQ ID NO: 259 - DNA, 727 bp, Arabidopsis thaliana
  G353 Predicted polypeptide sequence is paralogous to G354
accaaactcaaaaaacacaaaccacaagaggatcatttcattttttattgtttcgttttaatcatcatcatcagaagaaaaatggttgcgatatcggagatcaagtcgacggtggatgtcacggcggcgaattgtttgatgcttttatctagagttggacaagaaaacgttgacggtggcgatcaaaaacgcgttttcacatgtaaaacgtgtttgaagcagtttcattcgttccaagccttaggaggtcaccgtgcgagtcacaagaagcctaacaacgacgctttgtcgtctggattgatgaagaaggtgaaaacgtcgtcgcatccttgtcccatatgtggagtggagtttccgatgggacaagctttgggaggacacatgaggagacacaggaacgagagtggggctgctggtggcgcgttggttacacgcgctttgttgccggagcccacggtgactacgttgaagaaatctagcagtgggaagagagtggcttgtttggatctgagtctagggatggtggacaatttgaatctcaagttggagcttggaagaacagtttattgattttatttattttccttaaattttctgaatatatttgtttctctcattctttgaatttttcttaatattctagattatacatacatccgcagatttaggaaactttcatagagtgtaatcttttctttctgtaaaaatatattttacttgtagcaaa

SEQ ID NO: 260 - protein, 162 aa, Arabidopsis thaliana
  G353 polypeptide Paralogous  to G354
MVAISEIKSTVDVTAANCLMLLSRVGQENVDGGDQKRVFTCKTCLKQFHSFQALGGHRASHKKPNNDALSSGLMKKVKTSSHPCPICGVEFPMGQALGGHMRRHRNESGAAGGALVTRALLPEPTVTTLKKSSSGKRVACLDLSLGMVDNLNLKLELGRTVY

SEQ ID NO: 261 - DNA, 1285 bp, Arabidopsis thaliana
  G512 predicted polypeptide sequence is paralogous to G1452
aaagctccctgagcaagtgagaagagaccacactgagaagaaaaatccttcaggttatcgaaaattcccggattttactctttgggcggtggccgatttcttacgcgctctttttgtggcgactgttgtatacgcgcgagccttcatggacacgaaggcggttggagtttctaaggatacggcggcgtcgatggaagcgtcgacggtgtttcctgggtttaaattctcgccgacggatgtggagttgatttcgtattacctgaagcggaagatggatggcttggagaggtccgttgaggttataccggaccttgagatttacaatttcgagccttgggatttacccgataagtcgattgtgaaatctgatagcgagtggttcttcttctgtgcgcgtgggaaaaagtatccacatggttcacagaacaggagagcaacgaagatgggatactggaaagcaactgggaaagagcgtgatgtgaagtctggttctgaggtcattggaacaaagaggacgcttgttttccatattggtcgtgcaccaaaaggcgaaagaactgactggattatgcacgagtactgcgtgaaaggagtatctctggatgatgctatggttgtttgccgggttaggaggaacaaagaatacaatagtggtacaagtcagaaggcaccaaagccaaattcatcagccgagaagcatgcgaaagtccaaaatggcgctacgagttcagggagcccgtctgattgggacaacttggttgatttttacctagcaggtgaatcaggggagaaactactcgctgagatggcagagtcatcagaaaatctacaggtggataatgacgaggatttctttgcggatatcctaagagacgaaatcatcaatctcgatgaagcggtgatgacagggaacacaccaaacgaagtgccaacactagaatcagcatcaatggagataagggtacttcctttaccaaacatgatagacaaacaaatgtcatcactgttagaggaaagaccatcacagaagaagaaaggaaaagacgccacggaatcattgtcgagctgcttcgtgggtttatactcgatcaaatcagtgaacaaggcacgatgggatgttattataggtgtagtggctctgatagcaatgttgttttatctagaataagaggcttatggaagtagcgaaaaacagtgtcctagctatgtttgtatcatcttttctcggacattgacaaggattatatgatgtttttgtgtaaaaaaaaaaaaaaaaaaaaaaaaa

SEQ ID NO: 262 - protein, 340 aa, Arabidopsis thaliana
  G512 polypeptide; paralogous to G1452
MDTKAVGVSKDTAASMEASTVFPGFKFSPTDVELISYYLKRKMDGLERSVEVIPDLEIYNFEPWDLPDKSIVKSDSEWFFFCARGKKYPHGSQNRRATKMGYWKATGKERDVKSGSEVIGTKRTLVFHIGRAPKGERTDWIMHEYCVKGVSLDDAMVVCRVRRNKEYNSGTSQKAPKPNSSAEKHAKVQNGATSSGSPSDWDNLVDFYLAGESGEKLLAEMAESSENLQVDNDEDFFADILRDEIINLDEAVMTGNTPNEVPTLESASMEIRVLPLPNMIDKQMSSLLEERPSQKKKGKDATESLSSCFVGLYSIKSVNKARWDVIIGVVALIAMLFYLE

SEQ ID NO: 263 - DNA, 1394 bp, Arabidopsis thaliana
  G596 predicted polypeptide sequence is paralogous to G2789
taatttctctacttcagatttttttctccttagattaatttaattgagttattgtacatccctcaagctaagattctggttttgtgagttgagtggatgagaagaggagagattaactaaattagggtttcaattgtttactttttgtttgctttttatatcaagtaatggatcaggtctctcgctctcttcctccaccttttctctcaagagatctccatcttcacccacaccatcaattccagcatcagcagcagcagcagcaacagaatcacggccacgatatagaccagcaccgaatcggtgggctaaaacgtgaccgagatgctgatatcgatcccaacgagcactcttcagccggaaaagatcaaagtactcctggctccggtggagaaagcggcggcggaggaggaggagataatcacatcacgagaaggccacgtggcagaccagcgggatctaagaacaaaccaaaaccgccaatcatcatcactcgagacagcgcaaacgctctcaaatctcatgtcatggaagtagcaaacggatgtgacgtcatggaaagtgtcaccgtcttcgctcgccgtcgccaacgtggcatctgcgttttgagcggaaacggcgccgttaccaacgttaccataagacaaccagcttcagtacctggtggtggctcatctgtcgttaacttacacggacgtttcgagattctttctctctcgggatcattccttcctcctccggctccaccagctgcgtcaggtctaacgatttacttagccggtggtcagggacaggttgttggaggaagcgtggttggtccactcatggcttcaggacctgtagtgattatggcagcttcgtttggaaacgctgcgtatgagagactgccgttggaggaagacgatcaagaagagcaaacagctggagcggttgctaataatatcgatggaaacgcaacaatgggtggtggaacgcaaacgcaaactcagacgcagcagcaacagcaacaacagttgatgcaagatccgacgtcgtttatacaagggttgcctccgaatcttatgaattctgttcaattgccagctgaagcttattggggaactccgagaccatctttctaaatcgcgaagaaaaaacaagttagatacgttcgttgtttttaatttataatctctcttctgtcaagttttaattttctttttcttcttctttgttttctaaagataattgtagtctttgacgaagattcgtggtacgtatgaatcgaagagaatcgttttggtcatgggattgctcgatctattaggtttgagagggggtttgtgttttgcgttgactagcagattataaaattgttgattttcgagtttttattttcatgtgttggtgataaa

SEQ ID NO: 264 - protein, 317 aa, Arabidopsis thaliana
  G596 polypeptide; paralogous to G2789
MDQVSRSLPPPFLSRDLHLHPHHQFQHQQQQQQQNHGHDIDQHRIGGLKRDRDADIDPNEHSSAGKDQSTPGSGGESGGGGGGDNHITRRPRGRPAGSKNKPKPPIIITRDSANALKSHVMEVANGCDVMESVTVFARRRQRGICVLSGNGAVTNVTIRQPASVPGGGSSVVNLHGRFEILSLSGSFLPPPAPPAASGLTIYLAGGQGQVVGGSVVGPLMASGPVVIMAASFGNAAYERLPLEEDDQEEQTAGAVANNIDGNATMGGGTQTQTQTQQQQQQQLMQDPTSFIQGLPPNLMNSVQLPAEAYWGTPRPSF

SEQ ID NO: 265 - DNA, 925 bp, Arabidopsis thaliana
  G714 predicted polypeptide sequence is paralogous to G489
ccacgcgtccgcgtcaatctttgagtttggtagagaaatggatcaacaaggacaatcatcagctatgaactatggttcaaacccatatcaaaccaacgccatgaccactacaccaaccggttcagaccatccagcttaccatcagatccaccagcaacaacaacaacagctcactcaacagcttcaatctttctgggagactcaattcaaagagattgagaaaaccactgatttcaagaaccatagccttccattggcaagaatcaagaaaatcatgaaagctgatgaagatgtgcgtatgatctcggccgaggcgcctgttgtgttcgccagggcctgcgagatgtttattctggagcttacgttaaggtcttggaaccatactgaggagaacaagagaaggacgttgcagaagaatgatatcgcggctgcggtgactagaactgatatttttgattttcttgtggatattgttcctcgggaggatcttcgtgatgaagtcttgggtggtgttggtgctgaagctgctacagctgcgggttatccgtatggatacttgcctcctggaacagctccaattgggaacccgggaatggttatgggtaacccgggcgcgtatccgccgaaggcgtatatgggtcagccaatgtggcaacaaccaggacctgagcagcaggatcctgacaattagcttggcctaataaactagccgtctaattcgaagctctccccggtggatctactcaagaagaagaatgttaatagaaaactattgcgacataaaaagtttggtgtagtagaataatttctgttttatgatccatggatttatcaattgttattcagtttggtttatcttgtcatcaaactgttttcggtcaatgtaacaaattcataaattgagaattgaacttacaaaaggcta

SEQ ID NO: 266 - protein, 217 aa, Arabidopsis thaliana
  G714 polypeptide; paralogous to G489
MDQQGQSSAMNYGSNPYQTNAMTTTPTGSDHPAYHQIHQQQQQQLTQQLQSFWETQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGGVGAEAATAAGYPYGYLPPGTAPIGNPGMVMGNPGAYPPKAYMGQPMWQQPGPEQQDPDN

SEQ ID NO: 267 - DNA, 2603 bp, Arabidopsis thaliana
  G877  Predicted polypeptide sequence is paralogous to G175
caaagattagactaatccgactgtgtttttaatcaatcatcattttatttaggggagagaagttgtaaagttttgatttttttttctgggttttttctgtgagacccagaagaagaacagagagaggaagaaggagaagaaaaaaatatctctttctctccggctttcaacaaaatctctcttttttccttcatcagtgttaaattcggatccgggtcgggtgggttttcggtttttggtgttcggatcagagcacagttggatgttagcgacggaactgaggatttcagtttgcggctgcggcggctgtgacggtgtttgtgtgtcgtcttcttttatcaatcaggagtttcatcacagtttgatcagagattcagccaaattcttggatactaaatggctggttttgatgaaaatgttgctgtgatgggagaatgggtgcctcgtagtcctagtcccgggacacttttctcctctgctattggagaagagaagagctcgaaacgtgttcttgaaagagagttatctttgaatcatggtcaagttattggtttagaagaagacactagtagtaatcataacaaggattcttcacaaagcaatgtttttcgaggtggtctcagtgaaagaattgctgcaagagctggatttaatgctccaaggttgaacactgagaatatccgcaccaacaccgacttttccattgactctaaccttcgatctccttgcttaaccatctcttctcctggccttagccctgcaacactcttggaatctcctgttttcctttctaacccattggctcaaccttctccaactaccgggaaatttccatttcttcctggtgttaatggtaatgcattgtcttctgagaaagcgaaagacgagttctttgatgatattggagcatcattcagcttccatcctgtttcaagatcatcttcctctttcttccaaggcacaacagagatgatgtcagttgattatggtaactacaacaatagatcttcttctcatcaatccgcagaagaagtaaaacctggctctgaaaacatagaaagctccaatctttatgggattgaaactgacaatcaaaacgggcagaacaagacatctgatgtcactacaaacaccagtcttgaaaccgtggatcatcaagaggaagaagaagagcaaagacgcggtgattcgatggctggtggtgcgcctgcagaggatggatataactggaggaaatacggacaaaagttggtcaaaggaagtgagtatccgcgaagctattacaagtgcacaaacccgaattgtcaggtgaagaagaaagttgagagatcaagggaaggtcacatcacagagattatatacaaaggagctcataatcatcttaaacctccacctaatcgccgctcagggatgcaagtagatggaactgaacaagttgaacaacaacaacaacagagagattctgctgcaacgtgggttagttgtaataacactcaacaacaaggtggaagcaatgagaacaatgtcgaagagggatctacgagattcgagtatggaaaccaatctggatcaattcaagctcaaaccggaggtcaatacgagtcaggtgatcctgtggttgtggttgatgcttcttcaacattctctaatgatgaagatgaagatgatcgagggacacatggaagtgtttctttgggttacgatggaggaggaggaggtgggggaggagaaggagatgaatcagagtcgaaaagaaggaaactagaagcttttgcagcagagatgagtggatcaacaagagccatacgtgagccaagagttgttgtgcagacaacgagtgatgttgacattcttgatgatggttatcgctggcgaaaatatggtcagaaagttgtcaaaggcaatccaaatccaaggagttattacaaatgcacagctccaggatgtacagtgaggaaacatgttgaaagagcttctcatgatctcaaatccgttataacaacttacgaaggcaaacataaccatgacgtccccgctgcacgcaacagcagccacggaggcggtggtgatagtggtaacggtaacagcggcggttcagccgcagtttctcaccattaccacaacggtcatcactcagagccgccacgtgggagattcgacagacaagtcacaactaacaatcagtctccttttagccgtccctttagctttcagccacatttgggtcctccttctggtttctccttcggtttaggacaaaccggtttggttaatctttcaatgcctggtttagcgtatggtcaagggaaaatgccgggtttgcctcacccgtatatgacacaaccggttgggatgagtgaagcaatgatgcagagagggatggaaccaaaggttgaaccggtttcagattcaggacaatcggtatataaccagatcatgagtagattacctcagatttgaaatttactcttcttcttcttcttctgcatttggtcactccttataataacttttaatttctgcttcttcttcttctttcatttattggtttcaaactttggggaaggtaaaggctgttttattgttaaaaaaaaaaaaaaaaa

SEQ ID NO: 268 - protein, 687 aa, Arabidopsis thaliana
  G877 polypeptide  Paralogous  to G175
MAGFDENVAVMGEWVPRSPSPGTLFSSAIGEEKSSKRVLERELSLNHGQVIGLEEDTSSNHNKDSSQSNVFRGGLSERIAARAGFNAPRLNTENIRTNTDFSIDSNLRSPCLTISSPGLSPATLLESPVFLSNPLAQPSPTTGKFPFLPGVNGNALSSEKAKDEFFDDIGASFSFHPVSRSSSSFFQGTTEMMSVDYGNYNNRSSSHQSAEEVKPGSENIESSNLYGIETDNQNGQNKTSDVTTNTSLETVDHQEEEEEQRRGDSMAGGAPAEDGYNWRKYGQKLVKGSEYPRSYYKCTNPNCQVKKKVERSREGHITEIIYKGAHNHLKPPPNRRSGMQVDGTEQVEQQQQQRDSAATWVSCNNTQQQGGSNENNVEEGSTRFEYGNQSGSIQAQTGGQYESGDPVVVVDASSTFSNDEDEDDRGTHGSVSLGYDGGGGGGGGEGDESESKRRKLEAFAAEMSGSTRAIREPRVVVQTTSDVDILDDGYRWRKYGQKVVKGNPNPRSYYKCTAPGCTVRKHVERASHDLKSVITTYEGKHNHDVPAARNSSHGGGGDSGNGNSGGSAAVSHHYHNGHHSEPPRGRFDRQVTTNNQSPFSRPFSFQPHLGPPSGFSFGLGQTGLVNLSMPGLAYGQGKMPGLPHPYMTQPVGMSEAMMQRGMEPKVEPVSDSGQSVYNQIMSRLPQI

SEQ ID NO: 269 - DNA, 1008 bp, Arabidopsis thaliana
  G1357 predicted polypeptide sequence is paralogous to G1452
atggcagctgcaccaccgatcgagccggcggtgacgacgacgttccctggcttcaaattctccccgaccgacatcgaacttatatcttattacttgaagaggaagatggatggtttggagagatctgttgagattatacctgaggttgagatttacaacttcgagccttgggatttacctgataagtctatcgttaaatcggatagcgaatggttcttcttctgtgctcgcggtaagaagtatccccacggttcacagaacagaagagcaaccaagataggatattggaaagccacaggaaaagagcgtaatgtgaagtcaggttctgaggtcattggaacaaagagaacgcttgtattccacattggccgcgcgccaaaaggaggaagaacggaatggcttatgcatgagtactgcatgattggagtatcactggatgctctggttatttgccgacttaggaggaatactgaatttcaagggagtacaattcaaaagccaccacaaccaagtttaccactggataagcacgtaaacttgcggaatgaagctatttcagaaagtatttatggttgggaaactatggttgatttctacttatcaagtgagtcagggcaagaactacttagtgaaatagcagaatcttcacaatcttcacaaaatccacaggttcctagtgaagaagatttctatgccgatatactgagggatgaaatagtaaagctagatgatccggcggtatccggtaatacactgatcaatgtaccaaggcttcaaacagagtccaataccacaagagtactacctttacctgacatggtagacaaacaaatgcaatcgttgctacagaaactaccattacaaaatgacactggagaagagaacaacatatccatgtcaaattgctttatcggtatctactcgattaagtctataaaccgagcgcgatgggacgttgttgtttggttactcgttatgatagccgtgttggtgttttatttagtgtga

SEQ ID NO: 270 - protein, 335 aa, Arabidopsis thaliana
  G1357 polypeptide; paralogous to G1452
MAAAPPIEPAVTTTFPGFKFSPTDIELISYYLKRKMDGLERSVEIIPEVEIYNFEPWDLPDKSIVKSDSEWFFFCARGKKYPHGSQNRRATKIGYWKATGKERNVKSGSEVIGTKRTLVFHIGRAPKGGRTEWLMHEYCMIGVSLDALVICRLRRNTEFQGSTIQKPPQPSLPLDKHVNLRNEAISESIYGWETMVDFYLSSESGQELLSEIAESSQSSQNPQVPSEEDFYADILRDEIVKLDDPAVSGNTLINVPRLQTESNTTRVLPLPDMVDKQMQSLLQKLPLQNDTGEENNISMSNCFIGIYSIKSINRARWDVVVWLLVMIAVLVFYLV

SEQ ID NO: 271 - DNA, 844 bp, Arabidopsis thaliana
  G1387 Predicted polypeptide sequence is paralogous to G975
tctctctcccactctcactttctctcctattcttagttcgtgtcagaaacacacagagaaattaagaaccctaatttaaaacagaagaatggtacattcgaagaagttccgaggtgtccgccagcgtcagtggggttcttgggtttctgagattcgtcatcctctcttgaagagaagagtgtggctaggaacattcgacacggcggaaacagcggctagagcctacgaccaagccgcggttctaatgaacggccagagcgcgaagactaacttccccgtcatcaaatcgaacggttcaaattccttggagattaactctgcgttaaggtctcccaaatcattatcggaactattgaacgctaagctaaggaagaactgtaaagaccagacaccgtatctgacgtgtctccgcctcgacaacgacagctcacacatcggcgtctggcagaaacgcgccgggtcaaaaacgagtccaaactgggtcaagcttgttgaactaggtgacaaagttaacgcacgtcccggtggtgatattgagactaataagatgaaggtacgaaacgaagacgttcaggaagatgatcaaatggcgatgcagatgatcgaggagttgcttaactggacctgtcctggatctggatccattgcacaggtctaaaggagaatcattgaattatatgatcaagataataatatagttgagggttaataataatcgagggtaagtaatttacgtgtagctaataattaatataattttcgaacatatatatgaatatatgatagctctagaaatgagtacgtatatatacgtaaacatttttcctcaaatatagtatatgtg

SEQ ID NO: 272 - protein, 189 aa, Arabidopsis thaliana
  G1387 polypeptide Paralogous to G975
MVHSKKFRGVRQRQWGSWVSEIRHPLLKRRVWLGTFDTAETAARAYDQAAVLMNGQSAKTNFPVIKSNGSNSLEINSALRSPKSLSELLNAKLRKNCKDQTPYLTCLRLDNDSSHIGVWQKRAGSKTSPNWVKLVELGDKVNARPGGDIETNKMKVRNEDVQEDDQMAMQMIEELLNWTCPGSGSIAQV

SEQ ID NO: 273 - DNA, 896 bp, Arabidopsis thaliana
  G1634 predicted polypeptide sequence is paralogous to G2701
ttatctcgtagcctttaaacgatggagactctgcatccactactctcgcacgtgccaacttctgaccaccggtttgtagttcaagagatgatgtgcttgcaaagctcgagctggactaaagaagagaacaagaagtttgagcgagctcttgctgtctacgctgatgacacgcctgatcgctggttcaaagttgctgctatgatccctggaaagaccatatcagatgtcatgaggcaatactctaagcttgaagaagacctcttcgatatcgaagcaggacttgtcccgatcccgggttaccgttcagttactccttgtggatttgatcaggttgtgagtccacgtgactttgatgcgtatcgtaaacttcctaatggagccagaggatttgatcaagaccgtaggaaaggagttccatggacggaggaagaacacaggagattcttgttagggcttctcaagtatgggaaaggagattggagaaacatatcgaggaactttgtgggatcaaaaacaccaactcaggttgcaagtcatgcccaaaagtactaccaaagacagctttccggtgcgaaagacaaacgacggcctagcattcacgacatcaccaccgtcaatcttctcaatgccaatcttagccgtccatcgtctgatcacggttgcttagtctcaaaacaggccgagccgaaactagggttcaccgacagggataatgcagaggagggagttatgtttcttggtcagaatctatcctcggtcttctcttcctacgatcctgccattaagttttccggagcaaatgtttacggtgaaggaggttactgtatctcacaagatcttgaaacgagaaaatgagaattttgaaattttaactattgcaacgaaaccataattgc

SEQ ID NO: 274 - protein, 277 aa, Arabidopsis thaliana
  G1634 polypeptide  Paralogous to G2701
METLHPLLSHVPTSDHRFVVQEMMCLQSSSWTKEENKKFERALAVYADDTPDRWFKVAAMIPGKTISDVMRQYSKLEEDLFDIEAGLVPIPGYRSVTPCGFDQVVSPRDFDAYRKLPNGARGFDQDRRKGVPWTEEEHRRFLLGLLKYGKGDWRNISRNFVGSKTPTQVASHAQKYYQRQLSGAKDKRRPSIHDITTVNLLNANLSRPSSDHGCLVSKQAEPKLGFTDRDNAEEGVMFLGQNLSSVFSSYDPAIKFSGANVYGEGGYCISQDLETRK

SEQ ID NO: 275 - DNA, 625 bp, Arabidopsis thaliana
  G1889  Predicted polypeptide sequence is paralogous to G354
acacgatcaaaactcattattcaacaaagtcttcgtttcatttttcatttttcatttctcaaccaaaaaaaaaaagagtgattttttttttaatcatcagtcaaatggaaaggggaagatcagatatggagatgataaacaacatggcaaattgcttgattcttctatcaaaggcccatcaaaacgacaccaaaagccgtgttttcgcgtgcaagacatgcaacaaagagttcccgtcgttccaagccttgggaggtcaccgagccagccaccggcgatccgcagcgcttgaaggccacgcacctccttctcctaagagagtcaaaccggtgaaacacgagtgtcccatatgtggtgctgagttcgcggtagggcaggccttaggtggtcacatgaggaagcatagaggtggatcaggaggaggaggtggccggagtttggcgccggctacagcgccggtgacgatgaagaaatcaggcggtggtaatggaaaaagagttttgtgtttggacttgaacttgacgcctttagagaacgaagatttgaagttggagcttgggaggtttattttctgatttttgttcgtttttctttttagggtatacttgtgtagggtaagtttatt

SEQ ID NO: 276 - protein, 156 aa, Arabidopsis thaliana
  G1889 polypeptide  Paralogous to G354
MERGRSDMEMINNMANCLILLSKAHQNDTKSRVFACKTCNKEFPSFQALGGHRASHRRSAALEGHAPPSPKRVKPVKHECPICGAEFAVGQALGGHMRKHRGGSGGGGGRSLAPATAPVTMKKSGGGNGKRVLCLDLNLTPLENEDLKLELGRFIF

SEQ ID NO: 277 - DNA, 1323 bp, Arabidopsis thaliana
  G1940  Predicted polypeptide sequence is paralogous to G2854
tcgactttgtccgtcgtagtgatgcagcaaccaccgtcaaacgccgccggagctggacagataccatcaggacaacagcatttgtggatgatgatgcaacagcagcagcagcagcagcagatgcagttgtctgcggcgccactaggtcaacatcagtacggtattggatctcagaatccaggatccgctagcgatgttaagtcgttgtggatcggagacttgcagcaatggatggacgagaactacatcatgagcgtctttgctcagtctggcgaggctacatcagctaaagtcattcgtaataagctgacgggacaatctgaaggttatggattcattgagttcgtcagccactctgtagcagagcgggttttgcagacttacaatggtgctcccatgccgagcactgaacagacgtttaggctcaactgggctcaggctggggctggagagaaacgattccagactgaagggcctgaccataccattttcgtaggtgacttggcacctgaggtgactgactatatgctctcggacacattcaagaatgtgtatgggtctgtcaaaggggctaaagttgtgcttgacaggaccactggaaggtccaaggggtatgggtttgttagggttgcggatgaaaatgagcagatgcgtgccatgactgaaatgaatggtcaatactgctcgacaaggcctatgcgtattggtccggctgccaataagaatgctcttccgatgcaaccagctatgtatcaaaacactcaaggagcaaatgctggagataatgatcctaataacacaacaatttttgttggaggtctggatgctaatgttacagacgatgaattaaagtcaatttttggtcaatttggtgaacttcttcatgtgaaaatacctccaggaaaacgttgtggattcgttcaatatgccaacaaggcgtctgcagagcatgcactttcggtgctgaatggaacacaattaggtggacaaagcatccgtctttcgtggggacgtagtccaaacaagcagtctgatcaagcgcaatggaacggtggtggatactatggataccctccacagccacagggcggctatggttatgcagctcaaccaccaactcaagaccctaatgcgtactatggtggttacactggctatggcaactatcagcagcaacgtcagtgaaacatcaacatcagctatttctaccaatgtcttggaacaaaagatgagcgattgtgtcttattaggacttctagattaaaagtgctctctttttgtttgagttttattttgcaaatgagtcgatcttgaatttgctat

SEQ ID NO: 278 - protein, 387 aa, Arabidopsis thaliana
  G1940 polypeptide; paralogous to G2854
MQQPPSNAAGAGQIPSGQQHLWMMMQQQQQQQQMQLSAAPLGQHQYGIGSQNPGSASDVKSLWIGDLQQWMDENYIMSVFAQSGEATSAKVIRNKLTGQSEGYGFIEFVSHSVAERVLQTYNGAPMPSTEQTFRLNWAQAGAGEKRFQTEGPDHTIFVGDLAPEVTDYMLSDTFKNVYGSVKGAKVVLDRTTGRSKGYGFVRVADENEQMRAMTEMNGQYCSTRPMRIGPAANKNALPMQPAMYQNTQGANAGDNDPNNTTIFVGGLDANVTDDELKSIFGQFGELLHVKIPPGKRCGFVQYANKASAEHALSVLNGTQLGGQSIRLSWGRSPNKQSDQAQWNGGGYYGYPPQPQGGYGYAAQPPTQDPNAYYGGYTGYGNYQQQRQ

SEQ ID NO: 279 - DNA, 513 bp, Arabidopsis thaliana
  G1974  Predicted polypeptide sequence is paralogous to G354
atggttgctgaaagtgataatcgtgatctgacggtggatacggcggcgagctgtctgatgttgttatcaggaattggagaacacgacggaagaaagaaacgtgttttccgatgcaagacttgtgagagagacttcgattcgttccaagctttaggaggccaccgtgcaagccactcgaaactaaccaacagtgacgataaatcacttcctggatcaccaaagaagaagcctaaaactacgactacgacgacggctcatacttgtccgatttgtggcttggagtttccgatgggacaagctcttggtggtcacatgaggaaacataggaacgagaaagaacgagaaaaggcttctaacgtattggttacgcattctttcatgccggagacgacaacggtgacgactttgaagaaatcgagtagtgggaagagagtggcgtgtttggatttcgacttaacttcggtggagagctttgtcaacacggaattggagttgggaagaacgatgtactga

SEQ ID NO: 280 - protein, 170 aa, Arabidopsis thaliana
  G1974 polypeptide  Paralogous to G354
MVAESDNRDLTVDTAASCLMLLSGIGEHDGRKKRVFRCKTCERDFDSFQALGGHRASHSKLTNSDDKSLPGSPKKKPKTTTTTTAHTCPICGLEFPMGQALGGHMRKHRNEKEREKASNVLVTHSFMPETTTVTTLKKSSSGKRVACLDFDLTSVESFVNTELELGRTMY

SEQ ID NO: 281 - DNA, 1383 bp, Arabidopsis thaliana
  G2153 Predicted polypeptide sequence is paralogous to G1073
ttcttgcttagtatcattctttgtcgtgttcttttaattaaccttttgcaatttgtcttgtgtttctcacaacacaaaaacttgtaaaagtgttaaaaaatcaagatctgaaaaatcttatcaccgcttctaggtttttcagttttttttcttccttttcctgatctaaattaacttatatttcttagggtttcacttcttgaaacatttaatcagaattaattaacctctctagggctttcatggcgaatccatggtggacaggacaagtgaacctatccggcctcgaaacgacgccgcctggttcctctcagttaaagaaaccagatctccacatctccatgaacatggccatggactcaggtcacaataatcatcaccatcaccaagaagtcgataacaacaacaacgacgacgatagagacaacttgagtggagacgaccacgagccacgtgaaggagccgtagaagcccccacgcgccgtccacgtggacgtcctgctggttccaagaacaaaccaaagccaccgatcttcgtcactcgcgattctccaaatgctctcaagagccatgtcatggagatcgctagtgggactgacgtcatcgaaaccctagctacttttgctaggcggcgtcaacgtggcatctgcatcttgagcggaaatggcacagtggctaacgtcaccctccgtcaaccctcgaccgctgccgttgcggcggctcctggtggtgcggctgttttggctttacaagggaggtttgagattctttctttaaccggttctttcttgccaggaccggctccacctggttccaccggtttaacgatttacttagccggtggtcaaggtcaggttgttggaggaagcgtggtgggcccattgatggcagcaggtccggtgatgctgatcgccgccacgttctctaacgcgacttacgagagattgccattggaggaggaagaggcagcagagagaggcggtggtggaggcagcggaggagtggttccggggcagctcggaggcggaggttcgccactaagcagcggtgctggtggaggcgacggtaaccaaggacttccggtgtataatatgccgggaaatcttgtttctaatggtggcagtggtggaggaggacagatgagcggccaagaagcttatggttgggctcaagctaggtcaggattttaacgtgcgttaaaatggtttttaatttacagaagttaacaataagattataatgatgtttattatgatgatgaaaaccagtcagttgctacttgttactagtgagctatatagtttgtggacattatattatgttctctcttgactatgattattatttgctaaatttcacttagctaaaaaaaaaaaaaaaaaa

SEQ ID NO: 282 - protein, 315 aa, Arabidopsis thaliana
  G2153 polypeptide  Paralogous to G1073
MANPWWTGQVNLSGLETTPPGSSQLKKPDLHISMNMAMDSGHNNHHHHQEVDNNNNDDDRDNLSGDDHEPREGAVEAPTRRPRGRPAGSKNKPKPPIFVTRDSPNALKSHVMEIASGTDVIETLATFARRRQRGICILSGNGTVANVTLRQPSTAAVAAAPGGAAVLALQGRFEILSLTGSFLPGPAPPGSTGLTIYLAGGQGQVVGGSVVGPLMAAGPVMLIAATFSNATYERLPLEEEEAAERGGGGGSGGVVPGQLGGGGSPLSSGAGGGDGNQGLPVYNMPGNLVSNGGSGGGGQMSGQEAYGWAQARSGF

SEQ ID NO: 283 - DNA, 653 bp, Arabidopsis thaliana
  G2583  Predicted polypeptide sequence is paralogous to G975
caaatcagaaaatatagagtttgaaggaaactaaaagatggtacattcgaggaagttccgaggtgtccgccagcgacaatggggttcttgggtctctgagattcgccatcctctattgaagagaagagtgtggcttggaactttcgaaacggcagaagcggctgcaagagcatacgaccaagcggctcttctaatgaacggccaaaacgctaagaccaatttccctgtcgtaaaatcagaggaaggctccgatcacgttaaagatgttaactctccgttgatgtcaccaaagtcattatctgagcttttgaacgctaagctaaggaagagctgcaaagacctaacgccttctttgacgtgtctccgtcttgatactgacagttcccacattggagtttggcagaaacgggccgggtcgaaaacaagtccgacttgggtcatgcgcctcgaacttgggaacgtagtcaacgaaagtgcggttgacttagggttgactacgatgaacaaacaaaacgttgagaaagaagaagaagaagaagaagctattattagtgatgaggatcagttagctatggagatgatcgaggagttgctgaattggagttgacttttgactttaacttgttgcaagtccacaaggggtaagggttttc

SEQ ID NO: 284 - protein, 189 aa, Arabidopsis thaliana
  G2583 polypeptide  Paralogous to G975
MVHSRKFRGVRQRQWGSWVSEIRHPLLKRRVWLGTFETAEAAARAYDQAALLMNGQNAKTNFPVVKSEEGSDHVKDVNSPLMSPKSLSELLNAKLRKSCKDLTPSLTCLRLDTDSSHIGVWQKRAGSKTSPTWVMRLELGNVVNESAVDLGLTTMNKQNVEKEEEEEEAIISDEDQLAMEMIEELLNWS

SEQ ID NO: 285 - DNA, 407 bp, Arabidopsis thaliana
  G226 Predicted polypeptide sequences is paralogous to G682
ccagtagttatggataataccaaccgtcttcgtcttcgtcgcggtcccagtcttaggcaaactaagttcactcgatcccgatatgactctgaagaagtgagtagcatcgaatgggagtttatcagtatgaccgaacaagaagaagatctcatctctcgaatgtacagacttgtcggtaataggtgggatttaatagcaggaagagtcgtaggaagaaaggcaaatgagattgagagatactggattatgagaaactctgactatttttctcacaaacgacgacgtcttaataattctccctttttttctacttctcctcttaatctccaagaaaatctaaaattgtaaagaaatcaaaataaaagctttcaatcataaaagtagaacaaatcttgaatgtcttctca

SEQ ID NO: 286 - protein, 112 aa, Arabidopsis thaliana
  G226 polypeptide  Paralogous to G682
MDNTNRLRLRRGPSLRQTKFTRSRYDSEEVSSIEWEFISMTEQEEDLISRMYRLVGNRWDLIAGRVVGRKANEIERYWIMRNSDYFSHKRRRLNNSPFFSTSPLNLQENLKL

SEQ ID NO: 287 - DNA, 832 bp, Arabidopsis thaliana
  G481  Predicted polypeptide sequence is paralogous to G482
gagcgtttcgtagaaaaattcgatttctctaaagccctaaaactaaaacgactatccccaattccaagttctagggtttccatcttccccaatctagtataaatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaaaagaagttgcaagtagtgattaagaacaatcgccaaatgatcaagggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtccacatcctgttgttattttcgattcactttcggaatttcatagctaatttattctcatttaataccaaatccttaaattaa

SEQ ID NO: 288 - protein, 141 aa, Arabidopsis thaliana
  G481 polypeptide  Paralogous to G482
MADTPSSPAGDGGESGGSVREQDRYLPIANISRIMKKALPPNGKIGKDAKDTVQECVSEFISFITSEASDKCQKEKRKTVNGDDLLWAMATLGFEDYLEPLKIYLARYRELEGDNKGSGKSGDGSNRDAGGGVSGEEMPSW

SEQ ID NO: 289 - DNA, 1065 bp, Arabidopsis thaliana
  G482  Predicted polypeptide sequence is paralogous to G481
tcgacccacgcgtccggacacttaacaattcacaccttctctttttactcttcctaaaaccctaaatttcctcgcttcagtcttcccactcaagtcaaccaccaattgaattcgatttcgaatcattgatggaaatgatttgaaaaaagagtaaagtttatttttttattccttgtaattttcagaaatgggggattccgacagggattccggtggagggcaaaacgggaacaaccagaacggacagtcctccttgtctccaagagagcaagacaggttcttgccgatcgctaacgtcagccggatcatgaagaaggccttgcccgccaacgccaagatctctaaagatgccaaagagacgatgcaggagtgtgtctccgagttcatcagcttcgtcaccggagaagcatctgataagtgtcagaaggagaagaggaagacgatcaacggagacgatttgctctgggctatgactactctaggttttgaggattatgttgagccattgaaagtttacttgcagaggtttagggagatcgaaggggagaggactggactagggaggccacagactggtggtgaggtcggagagcatcagagagatgctgtcggagatggcggtgggttctacggtggtggtggtgggatgcagtatcaccaacatcatcagtttcttcaccagcagaaccatatgtatggagccacaggtggcggtagcgacagtggaggtggagctgcctccggtaggacaaggacttaacaaagattggtgaagtggatctctctctgtatatagatacataaatacatgtatacacatgcctatttttacgacccatataaggtatctatcatgtgatagaacgaacattggtgttggtgatgtaaaatcagatgtgcattaagggtttagattttgaggctgtgtaaaagaagatcaagtgtgctttgttggacaataggattcactaacgaatctgcttcattggatcttgtatgtaactaaagccattgtattgaatgcaaatgttttcatttgggatgctttaaaaaaaaaaaaaaaaa

SEQ ID NO: 290 - protein, 190 aa, Arabidopsis thaliana
  G482 polypeptide  Paralogous to G481
MGDSDRDSGGGQNGNNQNGQSSLSPREQDRFLPIANVSRIMKKALPANAKISKDAKETMQECVSEFISFVTGEASDKCQKEKRKTINGDDLLWAMTTLGFEDYVEPLKVYLQRFREIEGERTGLGRPQTGGEVGEHQRDAVGDGGGFYGGGGGMQYHQHHQFLHQQNHMYGATGGGSDSGGGAASGRTRT

SEQ ID NO: 291 - DNA, 684 bp, Arabidopsis thaliana
  G485  Predicted polypeptide sequence is paralogous to G481 and G482
cctctctgatccaacggacccaaaacatctatctctctttctcgaccttttgtctcctcgatctaaagatggcggattcggacaacgattcaggaggacacaaagacggtggaaatgcttcgacacgtgagcaagataggtttctaccgatcgctaacgttagcaggatcatgaagaaagcacttcctgcgaacgcaaaaatctctaaggatgctaaagaaacggttcaagagtgtgtatcggaattcataagtttcatcaccggtgaggcttctgacaagtgtcagagagagaagaggaagacaatcaacggtgacgatcttctttgggcgatgactacgctagggtttgaggactacgtggagcctctcaaggtttatctgcaaaagtatagggaggtggaaggagagaagactactacggcagggagacaaggcgataaggaaggtggaggaggaggcggtggagctggaagtggaagtggaggagctccgatgtacggtggtggcatggtgactacgatgggacatcaattttcccatcatttttcttaattgtaaaatgataaaagcaaattttcatttttattaattaatgatatatatatatatatgtttaacttttagtataatgtttacagaattttttttttaaaactaggttcaacccactaacgtaacagcg

SEQ ID NO: 292 - protein, 161 aa, Arabidopsis thaliana
  G485 polypeptide  Paralogous to G481 and G482
MADSDNDSGGHKDGGNASTREQDRFLPIANVSRIMKKALPANAKISKDAKETVQECVSEFISFITGEASDKCQREKRKTINGDDLLWAMTTLGFEDYVEPLKVYLQKYREVEGEKTTTAGRQGDKEGGGGGGGAGSGSGGAPMYGGGMVTTMGHQFSHHFS

SEQ ID NO: 293 - DNA, 476 bp, Arabidopsis thaliana
  G486  functionally related and homologous to G481 and G482
gcgagagctgatagattcactgaaacaaaagagaaaaatgacagacgaagatagattgttgccaatagccaatgtagggagacttatgaagcaaatcctaccatcaaatgcaaagatctcaaaagaagcaaaacaaacagttcaagaatgtgcaacagagttcataagctttgttacatgcgaagcatcagagaagtgccacagggagaatcggaagacggtgaatggagacgacatctggtgggctctcagcactctcggcctcgataactatgctgacgccgtgggtaggcatcttcacaagtaccgtgaagccgagagagaaagaactgagcacaacaaaggtagcaatgatagtgggaatgagaaagaaaccaacactagaagtgatgtacagaaccaatcgacaaaatttattagagttgttgagaagggaagcagctcctcggcccgttgaactagacatctaagttctg

SEQ ID NO: 294 - protein, 139 aa, Arabidopsis thaliana
  G486 polypeptide  functionally related and homologous to G481 and G482
MTDEDRLLPIANVGRLMKQILPSNAKISKEAKQTVQECATEFISFVTCEASEKCHRENRKTVNGDDIWWALSTLGLDNYADAVGRHLHKYREAERERTEHNKGSNDSGNEKETNTRSDVQNQSTKFIRVVEKGSSSSAR

SEQ ID NO: 295 - DNA, 1473 bp, Arabidopsis thaliana
  G1067 Predicted polypeptide sequence is paralogous to G1073
tctcaagcttctctctcctttttttcccatagcacatcagaatcgctaaatacgactcctatgcaaagaagaagctacttctttctcttgccctaattaatctacctaactagggtttcctcttacctttcatgagagagatcatttaacataagtcaccttttttatatcttttgcttcgtctttaatttagttctgttcttggtctgtttctatattttgtcggcttgcgtaaccgatcacaccttaatgctttagctattgtttcctcaaaatcatgagttttgacttctcgatctgagttttctttttctctctttacgctcttcttcacctagctaccaatatatgaacgagcaggatcaagaatcgagaaattgatttgagctggcgaataagcagtggtgggatagggaattagtagatgcggcggcgatggaaggcggttacgagcaaggcggtggagcttctagatacttccataacctctttagaccggagattcaccaccaacagcttcaaccgcagggcgggatcaatcttatcgaccagcatcatcatcagcaccagcaacatcaacaacaacaacaaccgtcggatgattcaagagaatctgaccattcaaacaaagatcatcatcaacagggtcgacccgattcagacccgaatacatcaagctcagcaccgggaaaacgtccacgtggacgtccaccaggatctaagaacaaagccaagccaccgatcatagtaactcgtgatagccccaacgcgcttagatctcacgttcttgaagtatctcctggagctgacatagttgagagtgtttccacgtacgctaggaggagagggagaggcgtctccgttttaggaggaaacggcaccgtatctaacgtcactctccgtcagccagtcactcctggaaatggcggtggtgtgtccggaggaggaggagttgtgactttacatggaaggtttgagattctttcgctaacggggactgttttgccacctcctgcaccgcctggtgccggtggtttgtctatatttttagccggagggcaaggtcaggtggtcggaggaagcgttgtggctccccttattgcatcagctccggttatactaatggcggcttcgttctcaaatgcggttttcgagagactaccgattgaggaggaggaagaagaaggtggtggtggcggaggaggaggaggaggagggccaccgcagatgcaacaagctccatcagcatctccgccgtctggagtgaccggtcagggacagttaggaggtaatgtgggtggttatgggttttctggtgatcctcatttgcttggatggggagctggaacaccttcaagaccacctttttaattgaattttaatgtccggaaatttatgtgtttttatcatcttgaggagtcgtctttcctttgggatatttggtgtttaatgtttagttgatatgcatatttt

SEQ ID NO: 296 - protein, 311 aa, Arabidopsis thaliana
  G1067 polypeptide Paralogous to G1073
MEGGYEQGGGASRYFHNLFRPEIHHQQLQPQGGINLIDQHHHQHQQHQQQQQPSDDSRESDHSNKDHHQQGRPDSDPNTSSSAPGKRPRGRPPGSKNKAKPPIIVTRDSPNALRSHVLEVSPGADIVESVSTYARRRGRGVSVLGGNGTVSNVTLRQPVTPGNGGGVSGGGGVVTLHGRFEILSLTGTVLPPPAPPGAGGLSIFLAGGQGQVVGGSVVAPLIASAPVILMAASFSNAVFERLPIEEEEEEGGGGGGGGGGGPPQMQQAPSASPPSGVTGQGQLGGNVGGYGFSGDPHLLGWGAGTPSRPPF

SEQ ID NO: 297 - DNA, 1295 bp, Arabidopsis thaliana
  G1070  Functionally related and homologous to G1073
tcgaccagcttggatttcgttgttcatcattactactctctttcttcttctagctagctagttttgacagcaaaataagaagcaaaaaaaaggtcaactaaaaaagatctgttcttagatcactctcttcttctttttttgatccaattccaccattgaatcatagatcatggatccagtacaatctcatggatcacaaagctctctacctcctcctttccacgcaagagactttcaattacatcttcaacaacagcaacaagagttcttcctccaccatcaccagcaacaaagaaaccaaaccgatggtgaccaacaaggaggatcaggaggaaaccgacaaatcaagatggatcgtgaagagacaagcgacaacatagacaacatagctaacaacagcggtagtgaaggtaaagacatagatatacacggtggttcaggagaaggaggtggtggctccggaggagatcatcagatgacaagaagaccaagaggaagaccagcgggatccaagaacaaaccaaaaccaccgattatcatcacacgggacagcgcaaacgcgcttagaacccacgtgatggagatcggagatggctgcgacttagtcgaaagcgttgccacttttgcacgaagacgccaacgcggcgtttgcgttatgagcggtactggaaatgttactaacgtcactatacgtcagcctggatctcatccttctcctggctcggtagttagtcttcacggaaggttcgagattctatctctctcaggatcttttctccctcctccggctcctcctacagccaccggattgagtgtttacctcgctggaggacaaggacaggtggttggaggaagcgtagttggtccgttgttatgtgctggtcctgtcgttgtcatggctgcgtcttttagcaatgcggcgtacgaaaggttgcctttagaggaagatgagatgcagacgccggttcatggcggaggaggaggaggatcattggagtcgccgccaatgatgggacaacaactgcaacatcagcaacaagctatgtcaggtcatcaagggttaccacctaatcttcttggttcggttcagttgcagcagcaacatgatcagtcttattggtcaacgggacgaccaccgtattgatcaaatatacacacacactcataatcgttgctagctagctaacgatgaatcatgagtttagtggatatatatatgattaaaagaggttagcttatgaacattaataagagtttggattctatcgagcttcattatgtttgggtcatcgttc

SEQ ID NO: 298 - protein, 324 aa, Arabidopsis thaliana
  G1070 polypeptide  Functionally related and homologous to G1073
MDPVQSHGSQSSLPPPFHARDFQLHLQQQQQEFFLHHHQQQRNQTDGDQQGGSGGNRQIKMDREETSDNIDNIANNSGSEGKDIDIHGGSGEGGGGSGGDHQMTRRPRGRPAGSKNKPKPPIIITRDSANALRTHVMEIGDGCDLVESVATFARRRQRGVCVMSGTGNVTNVTIRQPGSHPSPGSVVSLHGRFEILSLSGSFLPPPAPPTATGLSVYLAGGQGQVVGGSVVGPLLCAGPVVVMAASFSNAAYERLPLEEDEMQTPVHGGGGGGSLESPPMMGQQLQHQQQAMSGHQGLPPNLLGSVQLQQQHDQSYWSTGRPPY

SEQ ID NO: 299 - DNA, 974 bp, Arabidopsis thaliana
  G1073 reference sequence
ccccccgacctgcctctacagagacctgaagattccagaaccccacctgatcaaaaataacatggaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgttttagagttttagcgttttggtgacaccttttgttgcgtttgcgtgtttgacctcaaactactaggctactagctatagcggttgcgaaatgcgaatattaggtt

SEQ ID NO: 300 - protein, 270 aa, Arabidopsis thaliana
  G1073 polypeptide reference sequence
MELNRSEADEAKAETTPTGGATSSATASGSSSGRRPRGRPAGSKNKPKPPTIITRDSPNVLRSHVLEVTSGSDISEAVSTYATRRGCGVCIISGTGAVTNVTIRQPAAPAGGGVITLHGRFDILSLTGTALPPPAPPGAGGLTVYLAGGQGQVVGGNVAGSLIASGPVVLMAASFANAVYDRLPIEEEETPPPRTTGVQQQQPEASQSSEVTGSGAQACESNLQGGNGGGGVAFYNLGMNMNNFQFSGGDIYGMSGGSGGGGGGATRPAF

SEQ ID NO: 301 - DNA, 1084 bp, Arabidopsis thaliana
  G1075 Functionally related and homologous to G1073
tttgtgtttggtgctggcatggctggtctcgatctaggcacaacttctcgctacgtccacaacgtcgatggtggcggcggcggacagttcaccaccgacaaccaccacgaagatgacggtggcgctggaggaaaccaccatcatcaccatcataatcataatcaccatcaaggtttagatttaatagcttctaatgataactctggactaggcggcggtggaggaggagggagcggtgacctcgtcatgcgtcggccacgtggccgtccagctggatcgaagaacaaaccgaagccgccggtgattgtcacgcgcgagagcgcaaacactcttagggctcacattcttgaagttggaagtggctgcgacgttttcgaatgtatctccacttacgctcgtcggagacagcgcgggatttgcgttttatccgggacgggaaccgtcactaacgtcagcatccgtcagcctacggcggccggagctgttgtgactctgcggggtacttttgagattctttccctctccggatcttttcttccgccacctgctcctccaggggcgactagcttgacgatattcctcgctggagctcaaggacaggtcgtcggaggtaacgtagttggtgagttaatggcggcggggccggtaatggtcatggcagcgtcttttacaaacgtggcttacgaaaggttgcctttggacgagcatgaggagcacttgcaaagtggcggcggcggaggtggagggaatatgtactcggaagccactggcggtggcggagggttgcctttctttaatttgccgatgagtatgcctcagattggagttgaaagttggcaggggaatcacgccggcgccggtagggctccgttttagcaatttaagaaactttaattgttttttccacttttttgtttttctccgaattttatgaaattatgatttaagaaaaaaaacgatattgttcatgtattgaccctcttactgcatggtttcttctattgggttaattggctagctcataagaattgtttaatttggttattgtcatcaaatttgcccacatataaagcttctagcaaat

SEQ ID NO: 302 - protein, 285 aa, Arabidopsis thaliana
  G1075 polypeptide Functionally related and homologous to G1073
MAGLDLGTTSRYVHNVDGGGGGQFTTDNHHEDDGGAGGNHHHHHHNHNHHQGLDLIASNDNSGLGGGGGGGSGDLVMRRPRGRPAGSKNKPKPPVIVTRESANTLRAHILEVGSGCDVFECISTYARRRQRGICVLSGTGTVTNVSIRQPTAAGAVVTLRGTFEILSLSGSFLPPPAPPGATSLTIFLAGAQGQVVGGNVVGELMAAGPVMVMAASFTNVAYERLPLDEHEEHLQSGGGGGGGNMYSEATGGGGGLPFFNLPMSMPQIGVESWQGNHAGAGRAPF

SEQ ID NO: 303 - DNA, 1342 bp, Arabidopsis thaliana
  G1076  Functionally related and homologous to G1073
attttagtcttcctataacttcttctcaatcctctctcatatcttttttcttagtttaaatttcaataaaatagaaaaaaacatatacaaatctacagagaagagaagctttattttaatcttgtgtgtgtgtgtgtgttttatataatttttattttttttcaaattaaaatctcttctttgcttttgatgtgggcatggctggtcttgatctaggcacagcttttcgttacgttaatcaccagctccatcgtcccgatctccaccttcaccacaattcctcctccgatgacgtcactcccggagccgggatgggtcatttcaccgtcgacgacgaagacaacaacaacaaccatcaaggtcttgacttagcctctggtggaggatcaggaagctctggaggaggaggaggtcacggcgggggaggagacgtcgttggtcgtcgtccacgtggcagaccaccgggatccaagaacaaaccgaaacctccggtaattatcacgcgcgagagcgcaaacactctaagagctcacattcttgaagtaacaaacggctgcgatgttttcgactgcgttgcgacttatgctcgtcggagacagcgagggatctgcgttctgagcggtagcggaacggtcacgaacgtcagcatacgtcagccatctgcggctggagcggttgtgacgctacaaggaacgttcgagattctttctctctccggatcgtttcttcctcctccggcacctcccggagcaacgagtttgacaattttcttagccggaggacaaggtcaggtggttggaggaagcgttgtgggtgagcttacggcggctggaccggtgattgtgattgcagcttcgtttactaatgttgcttatgagagacttcctttagaagaagatgagcagcagcaacagcttggaggaggatctaacggcggaggtaatttgtttccggaggtggcagctggaggaggaggaggacttccgttctttaatttaccgatgaatatgcaaccaaatgtgcaacttccggtggaaggttggccggggaattccggtggaagaggtcctttctgatgtgtatatattgataatcattatatatataccggcggagaagcttttccggcgaagaatttgcgagagtgaagaaaggttagaaaagcttttaatggactaatgaatttcaaattatcatcgtgatttcggacattgtcttgttcatcatgttaagcttaggtttattttttgtcgtttgtagaattttatgtttgaatccttttttttttctgtgaaactctattgtgttcgtctgcgaaggaaaaaaaaattctcaaaaaaaa

SEQ ID NO: 304 - protein, 292 aa, Arabidopsis thaliana
  G1076 polypeptide  Functionally related and homologous to G1073
MAGLDLGTAFRYVNHQLHRPDLHLHHNSSSDDVTPGAGMGHFTVDDEDNNNNHQGLDLASGGGSGSSGGGGGHGGGGDVVGRRPRGRPPGSKNKPKPPVIITRESANTLRAHILEVTNGCDVFDCVATYARRRQRGICVLSGSGTVTNVSIRQPSAAGAVVTLQGTFEILSLSGSFLPPPAPPGATSLTIFLAGGQGQVVGGSVVGELTAAGPVIVIAASFTNVAYERLPLEEDEQQQQLGGGSNGGGNLFPEVAAGGGGGLPFFNLPMNMQPNVQLPVEGWPGNSGGRGPF

SEQ ID NO: 305 - DNA, 483 bp, Arabidopsis thaliana
  G1248  Functionally related and homologous to G481 and G482
atggcggggaattatcattcgttccaaaatccaatccctcgataccagaattacaacttcgggagcagctcatctaatcatcaacatgaacatgatgggttagtggtggtggtggaggatcaacagcaagaagaaagcatgatggtaaaagaacaagacaggctacttccgatagcaaacgtaggaaggatcatgaagaacatcctcccagcaaacgcaaaggtctctaaagaagccaaagagactatgcaagaatgtgtgtccgagttcattagcttcgtcacgggagaagcatccgataaatgccacaaggagaagcgaaagaccgttaatggagacgatatctgttgggctatggctaatctagggtttgatgattacgccgcccagctcaagaagtacttacatcgttaccgagttctcgaaggtgagaaacctaatcatcacggcaaaggaggacctaaatcctcgccagataattaa

SEQ ID NO: 306 - protein, 160 aa, Arabidopsis thaliana
  G1248 polypeptide  Functionally related and homologous to G481 and G482
MAGNYHSFQNPIPRYQNYNFGSSSSNHQHEHDGLVVVVEDQQQEESMMVKEQDRLLPIANVGRIMKNILPANAKVSKEAKETMQECVSEFISFVTGEASDKCHKEKRKTVNGDDICWAMANLGFDDYAAQLKKYLHRYRVLEGEKPNHHGKGGPKSSPDN

SEQ ID NO: 307 - DNA, 823 bp, Arabidopsis thaliana
  G1364 Predicted polypeptide sequence is paralogous to G481 and G482
ctcttctctcgatctctctccctctctgcctcctctcttcctccaatcaacaaacacctctctgtttcactcccgccctttttcgaattcttctgatggcggagtcgcaggccaagagtcccggaggctgtggaagccatgagagtggtggagatcaaagtcccaggtcgttacatgttcgtgagcaagataggtttcttccgattgctaacataagccgtatcatgaaaagaggtcttcctgctaatgggaaaatcgctaaagatgctaaggagattgtgcaggaatgtgtctctgaattcatcagtttcgtcaccagcgaagcgagtgataaatgtcaaagagagaaaaggaagactattaatggagatgatttgctttgggcaatggctactttaggatttgaagactacatggaacctctcaaggtttacctgatgagatatagagagatggagggtgacacaaagggatcagcaaaaggtggggatccaaatgcaaagaaagatgggcaatcaagccaaaatggccagttctcgcagcttgctcaccaaggtccttatgggaactctcaagctcagcagcatatgatggttccaatgccgggaacagactagtatgagaggagtattcaactttggttatgttccaccaaaagaggttatcttatctgtatattatttgtgttgtaagagttttgctatgcagaacttgtgactataatcatctcattgttttgttttgtttttgtttccttggatttgttctgaatatgtcatcaagtcagtcagtctatttatatatttggtttgttgattatttc

SEQ ID NO: 308 - protein, 173 aa, Arabidopsis thaliana
  G1364 polypeptide Paralogous to G481 and G482
MAESQAKSPGGCGSHESGGDQSPRSLHVREQDRFLPIANISRIMKRGLPANGKIAKDAKEIVQECVSEFISFVTSEASDKCQREKRKTINGDDLLWAMATLGFEDYMEPLKVYLMRYREMEGDTKGSAKGGDPNAKKDGQSSQNGQFSQLAHQGPYGNSQAQQHMMVPMPGTD

SEQ ID NO: 309 - DNA, 757 bp, Arabidopsis thaliana
  G1781 Functionally related and homologous to G481 and G482
cgtcgaccagattgatcacatgtggttaacatcaatcaaaaaaaaaaacaaagagatagagatatgactgaggagagcccagaagaagatcatgggtctcctggagtagctgaaacaaatccaggaagcccttcttcaaagaccaacaacaacaacaacaacaacaaagaacaagaccggtttcttcccattgcgaatgtcggaaggatcatgaaaaaagttcttcccggtaacggtaagatctcaaaagacgctaaagaaaccgttcaagaatgtgtctcggagttcattagtttcgtcactggtgaagcttctgacaagtgtcaaagagaaaagaggaagaccatcaatggagatgatatcatttgggctatcacaactctcggtttcgaagactacgtggctccattaaaggtctacctctgcaaatatagagacaccgaaggagagaaagttaacagcccaaaacaacaacaacaaagacaacaacaacagcagattcaacaacagaatcatcataattatcagtttcaagaacaagaccaaaacaataacaacatgtcatgtactagttacatctctcatcatcatccttctccattcctaccagtggatcatcaaccttttcccaatattgctttctctcctaaatcattgcagaaacagttcccgcagcagcatgataataacattgattcaattcactggtgagagagacatttgcttgcgggccgctctaggcgggaaaagcccgaat

SEQ ID NO: 310 - protein, 215 aa, Arabidopsis thaliana
  G1781 polypeptide  Functionally related and homologous to G481 and G482
MTEESPEEDHGSPGVAETNPGSPSSKTNNNNNNNKEQDRFLPIANVGRIMKKVLPGNGKISKDAKETVQECVSEFISFVTGEASDKCQREKRKTINGDDIIWAITTLGFEDYVAPLKVYLCKYRDTEGEKVNSPKQQQQRQQQQQIQQQNHHNYQFQEQDQNNNNMSCTSYISHHHPSPFLPVDHQPFPNIAFSPKSLQKQFPQQHDNNIDSIHW

SEQ ID NO: 311 - DNA, 318 bp, Arabidopsis thaliana
  G1816  Predicted polypeptide sequence is paralogous to G682 and G226
atggataacactgaccgtcgtcgccgtcgtaagcaacacaaaatcgccctccatgactctgaagtgagcagtatcgaatgggagtttatcaacatgactgaacaagaagaagatctcatctttcgaatgtacagacttgtcggtgataggtgggatttgatagcaggaagagttcctggaagacaaccagaggagatagagagatattggataatgagaaacagtgaaggctttgctgataaacgacgccagcttcactcatcttcccacaaacataccaagcctcaccgtcctcgcttttctatctatccttcctag

SEQ ID NO: 312 - protein, 105 aa, Arabidopsis thaliana
  G1816 polypeptide  Paralogous to G682 and G226
MDNTDRRRRRKQHKIALHDSEVSSIEWEFINMTEQEEDLIFRMYRLVGDRWDLIAGRVPGRQPEEIERYWIMRNSEGFADKRRQLHSSSHKHTKPHRPRFSIYPS

SEQ ID NO: 313 - DNA, 1130 bp, Arabidopsis thaliana
  G1945 Functionally related and homologous to G1073
atttcccaaagggatttacgaaaagtccctctcctctatcatctctttattcaccccataccaacaacctctacatcttcttcttcttcttcctcctcttttattttctttttaaatcatttacacaaaaatccaaagacaaatctgaaatctctaataaacaaatccataaaataagaaaaacaaagatgaaaggtgaatacagagagcaaaagagtaacgaaatgttttccaagcttcctcatcatcaacaacaacagcaacaacaacaacaacaacactctcttacctctcacttccacctctcctccaccgtaacccccaccgtcgatgactcctccatcgaagtggtccgacgtccacgtggcagaccaccaggttccaaaaacaaacctaaaccacccgtcttcgtcacacgtgacaccgaccctcctatgagtccttacatcctcgaagttccttcaggaaacgacgtcgtcgaagccatcaaccgtttctgccgccgtaaatccatcggagtctgcgtccttagtggctctggctctgtagctaacgtcactttacgtcagccatcaccggcagctcttggctctaccataactttccatggaaagtttgatctcctctccgtctccgcaacgtttctccctcctccgcctcgtacttccttgtctcctcccgtttctaacttcttcaccgtctctctcgctggacctcaaggacaaatcatcggagggttcgtcgctggtccacttatttcggcaggaacagtttacgtcatcgccgcaagtttcaacaacccttcttatcaccggttaccggcggaagaagagcaaaaacactcggcggggacaggggaaagagagggacaatctccgccggtctctggtggcggtgaagagtcaggacagatggcgggaagtggaggagagtcgtgtggggtatcaatgtacagttgccacatgggtggctctgatgttatttgggcccctacagccagagctccaccgccatactaaccaatccttctttcacaaatctctttctttctttttttgtttttttttgttttgggttaggatgaatcaagaaactagggttttttttttttttttttaaaaaaaaaaaaa

SEQ ID NO: 314 - protein, 276 aa, Arabidopsis thaliana
  G1945 polypeptide Functionally related and homologous to G1073
MKGEYREQKSNEMFSKLPHHQQQQQQQQQQHSLTSHFHLSSTVTPTVDDSSIEVVRRPRGRPPGSKNKPKPPVFVTRDTDPPMSPYILEVPSGNDVVEAINRFCRRKSIGVCVLSGSGSVANVTLRQPSPAALGSTITFHGKFDLLSVSATFLPPPPRTSLSPPVSNFFTVSLAGPQGQIIGGFVAGPLISAGTVYVIAASFNNPSYHRLPAEEEQKHSAGTGEREGQSPPVSGGGEESGQMAGSGGESCGVSMYSCHMGGSDVIWAPTARAPPPY

SEQ ID NO: 315 - DNA, 1050 bp, Arabidopsis thaliana
  G2155 Functionally related and homologous to G1073
ctcatatataccaaccaaacctctctctgcatctttattaacacaaaattccaaaagattaaatgttgtcgaagctccctacacagcgacacttgcacctctctccctcctctccctccatggaaaccgtcgggcgtccacgtggcagacctcgaggttccaaaaacaaacctaaagctccaatctttgtcaccattgaccctcctatgagtccttacatcctcgaagtgccatccggaaacgatgtcgttgaagccctaaaccgtttctgccgcggtaaagccatcggcttttgcgtcctcagtggctcaggctccgttgctgatgtcactttgcgtcagccttctccggcagctcctggctcaaccattactttccacggaaagttcgatcttctctctgtctccgccactttcctccctcctctacctcctacctccttgtcccctcccgtctccaatttcttcaccgtctctctcgccggacctcaggggaaagtcatcggtggattcgtcgctggtcctctcgttgccgccggaactgtttacttcgtcgccactagtttcaagaacccttcctatcaccggttacctgctacggaggaagagcaaagaaactcggcggaaggggaagaggagggacaatcgccgccggtctctggaggtggtggagagtcgatgtacgtgggtggctctgatgtcatttgggatcccaacgccaaagctccatcgccgtactgaccacaaatccatctcgttcaaactagggtttcttcttctttagatcatcaagaatcaacaaaaagattgcatttttagattctttgtaatatcataattgactcactctttaatctctctatcacttcttctttagctttttctgcagtgtcaaacttcacatatttgtagtttgatttgactatccccaagttttgtattttatcatacaaatttttgcctgtctctaatggttgttttttcgtttgtataatcttatgcattgtttattggagctccagagattgaatgtataatataatggtttaat

SEQ ID NO: 316 - protein, 225 aa, Arabidopsis thaliana
  G2155 polypeptide  Functionally related and homologous to G1073
MLSKLPTQRHLHLSPSSPSMETVGRPRGRPRGSKNKPKAPIFVTIDPPMSPYILEVPSGNDVVEALNRFCRGKAIGFCVLSGSGSVADVTLRQPSPAAPGSTITFHGKFDLLSVSATFLPPLPPTSLSPPVSNFFTVSLAGPQGKVIGGFVAGPLVAAGTVYFVATSFKNPSYHRLPATEEEQRNSAEGEEEGQSPPVSGGGGESMYVGGSDVIWDPNAKAPSPY

SEQ ID NO: 317 - DNA, 1361 bp, Arabidopsis thaliana
  G2156 Predicted polypeptide sequence is paralogous to G1073
ttttttttccctttcctcgttcaaaaaaagtacttgcagagtcactcactctcagtctcagcacatgaattaatttgaagcttccctagaattctttcacatcaattaatacgacaccgtctcgggtgaagaatctctcctctcttgccctaaagcgagttagggtttaacacacaaagcataccctttagatttgtgtctcttagctctgtttttgtcggcttgtgtaaccgatcaactcaagctattggctcctcacctcctgaaatttgacttctccaatggatctcaaagtttctcttatatgaattctatcttcaccctcacaatatctttatatatatgagccacaagaacaagaagagtcagtagatgcggctgccatggacggtggttacgatcaatccggaggagcttctagatactttcacaacctcttcaggcctgagcttcatcaccagcttcaacctcagcctcaacttcaccctttgcctcagcctcagcctcaacctcagcctcagcagcagaattcagatgatgaatctgactccaacaaggatccgggttccgacccagttacctctggttcaaccgggaaacgtccacgtggacgtcctccgggatccaagaacaagccgaagccaccggtgatagtgactagagatagccccaacgtgcttagatctcatgttcttgaagtctcatctggagccgacatagtcgagagcgttaccacttacgctcgcaggagaggaagaggagtctccattctcagtggtaacggcacggtggctaacgtcagtctccggcagccggcaacgacagcggctcatggggcaaatggtggaaccggaggtgttgtggctctacatggaaggtttgagatactttccctcacaggtacggtgttgccgccccctgcgccgccaggatccggtggtctttctatctttctttccggcgttcaaggtcaggtgattggaggaaacgtggtggctccgcttgtggcttcgggtccagtgatactaatggctgcatcgttctctaatgcaactttcgaaaggcttccccttgaagatgaaggaggagaaggtggagagggaggagaagttggagagggaggaggaggagaaggtggtccaccgccggccacgtcatcatcaccaccatctggagccggtcaaggacagttaagaggtaacatgagtggttatgatcagtttgccggtgatcctcatttgcttggttggggagccgcagccgcagccgcaccaccaagaccagccttttagaattgaaaattatgtccgtaacatagctgtaaccaaatttcatttctcaaaattaaaagaaaaaaaaaa

SEQ ID NO: 318 - protein, 302 aa, Arabidopsis thaliana
  G2156 polypeptide Paralogous to G1073
MDGGYDQSGGASRYFHNLFRPELHHQLQPQPQLHPLPQPQPQPQPQQQNSDDESDSNKDPGSDPVTSGSTGKRPRGRPPGSKNKPKPPVIVTRDSPNVLRSHVLEVSSGADIVESVTTYARRRGRGVSILSGNGTVANVSLRQPATTAAHGANGGTGGVVALHGRFEILSLTGTVLPPPAPPGSGGLSIFLSGVQGQVIGGNVVAPLVASGPVILMAASFSNATFERLPLEDEGGEGGEGGEVGEGGGGEGGPPPATSSSPPSGAGQGQLRGNMSGYDQFAGDPHLLGWGAAAAAAPPRPAF

SEQ ID NO: 319 - DNA, 813 bp, Arabidopsis thaliana
  G2345 Predicted polypeptide sequence is paralogous to G481 and G482
cttctccagcgtcggatcagatcagatcaaatctctctctccatctccgtctcctcctccaatcatcatttctctctccgtctcccgctctttttcgaattctccttcttcttcagggtttctgagatggccgaatcgcaaaccggtggtggtggtggtggaagccatgagagtggcggtgatcagagcccgaggtctttgaatgttcgtgagcaggacaggtttcttccgattgctaacataagccgtatcatgaagagaggtttacctctaaatggcaaaatcgctaaagatgctaaagagactatgcaggaatgtgtctctgaattcatcagcttcgtcaccagcgaggctagtgataagtgccaaagagagaaaaggaagaccatcaatggagatgatttgctttgggctatggccactttaggattcgaagattacatcgatcccctcaaggtttacctgatgcgatatagagagatggagggtgacactaaaggatcaggaaaaggcggggaatcgagtgcaaagagagatggtcaaccaagccaagtgtctcagttctcgcaggttcctcaacaaggctcattctcacagggtccttatggaaactctcaatctctgaggttcggcaatagcatcgagcatcttgaagtgttaatgagtagtactaggacactattcatcacaatcttccgagactcgactatgcctgttgtgtctgagaatctgagtgatccactttccatagatatggattgtgaagctatttatcaccacttcattggcctgttgattctttcatgcaagtga

SEQ ID NO: 320 - protein, 228 aa, Arabidopsis thaliana
  G2345 polypeptide  Paralogous to G481 and G482
MAESQTGGGGGGSHESGGDQSPRSLNVREQDRFLPIANISRIMKRGLPLNGKIAKDAKETMQECVSEFISFVTSEASDKCQREKRKTINGDDLLWAMATLGFEDYIDPLKVYLMRYREMEGDTKGSGKGGESSAKRDGQPSQVSQFSQVPQQGSFSQGPYGNSQSLRFGNSIEHLEVLMSSTRTLFITIFRDSTMPVVSENLSDPLSIDMDCEAIYHHFIGLLILSCK

SEQ ID NO: 321 - DNA, 1424 bp, Arabidopsis thaliana
  G2657  Functionally related and homologous to G1073
gaaaataaaaccttaccaaatcaatcaaagaataagatgaagaacaaaattccagcttgatgtattttgtgaaaacattattattcttttcctcttctatctagagtctctcctaggtcaaattatcaaaatcaattctcatctcaacatagaatggatccagttcaatctcatggatcacaaagctctcttcctcctcctttccatgctagagatttccaattacatcttcaacaacaacaacaacatcaacaacaacatcaacaacaacaacaacaacagttctttctccaccatcatcagcaaccacaaagaaaccttgatcaagatcacgagcagcaaggagggtcaatattgaatagatctatcaagatggatcgcgaagagacaagcgataacatggacaacatcgctaataccaacagcggtagcgaaggtaaagagatgagtttacacggaggagaaggaggaagcggtggtggaggaagtggagaacagatgacaagaaggccaagaggaagaccagcaggatccaagaacaaacctaaagctccaataatcataacaagagacagcgcaaacgcgcttcgaactcacgtcatggagataggagacggatgtgacatagttgactgtatggctacgttcgctagacgccgccaaagaggcgtttgcgttatgagcggtacaggaagcgttactaacgtcactatacgtcagcctggatcgccacctggctcggtggttagccttcacggccggtttgaaatcctctctctttcgggatctttcttgcctccgcctgcgccgcctgcagccaccggactaagcgtttacctagccggaggacaagggcaggtcgttggaggtagtgtggtgggacctttgttgtgttcgggtcctgtggtggttatggcggcttcttttagcaatgcggcgtacgaaaggctgcctttggaagaagatgagatgcagacgccagttcaaggaggcggtggaggaggaggaggtggtggtggaatgggatctcccccgatgatgggacagcaacaagctatggcagctatggcggcggctcaaggactaccaccgaatcttcttggttcggttcagttgccaccgccacaacagaatgatcagcagtattggtctacgggtcggccaccgtattgattattagattgctattattatatatacatgatcaatggaatatatacatatatagctatgtatttgtatatatgtagctatttactaatagatcttacatatatataaagcaagctaacatggaatcattaaaaggaggtctacgaagtatgacgtgaagttgaagacggcgataatattgaagatcaacaattcagtagatggttttcaggttcttctttgttttttttgtttcctttgggttcgtttta

SEQ ID NO: 322 - protein, 339 aa, Arabidopsis thaliana
  G2657 polypeptide  Functionally related and homologous to G1073
MDPVQSHGSQSSLPPPFHARDFQLHLQQQQQHQQQHQQQQQQQFFLHHHQQPQRNLDQDHEQQGGSILNRSIKMDREETSDNMDNIANTNSGSEGKEMSLHGGEGGSGGGGSGEQMTRRPRGRPAGSKNKPKAPIIITRDSANALRTHVMEIGDGCDIVDCMATFARRRQRGVCVMSGTGSVTNVTIRQPGSPPGSVVSLHGRFEILSLSGSFLPPPAPPAATGLSVYLAGGQGQVVGGSVVGPLLCSGPVVVMAASFSNAAYERLPLEEDEMQTPVQGGGGGGGGGGGMGSPPMMGQQQAMAAMAAAQGLPPNLLGSVQLPPPQQNDQQYWSTGRPPY

SEQ ID NO: 323 - DNA, 252 bp, Arabidopsis thaliana
  G2718  Predicted polypeptide sequence is paralogous to G481 and G482
atgaatacgcagcgtaagtcgaagcatcttaagaccaatccaaccattgttgcctcttcttctgaagaagtgagcagtcttgagtgggaagaaatagcaatggctcaggaagaagaggatttgatttgcaggatgtataagcttgtcggtgaaaggtgggatttaatagctgggaggattccaggaagaacagcagaagagattgagaggttttgggtgatgaagaatcatcgaagatctcaattacgttga

SEQ ID NO: 324 - protein, 83 aa, Arabidopsis thaliana
  G2718 polypeptide  Paralogous to G481 and G482
MNTQRKSKHLKTNPTIVASSSEEVSSLEWEEIAMAQEEEDLICRMYKLVGERWDLIAGRIPGRTAEEIERFWVMKNHRRSQLR

SEQ ID NO: 325 - DNA, 321 bp, Oryza sativa (japonica cultivar-group)
  G3392 Predicted polypeptide sequence is orthologous to G682
gctctaaactaccataaaatcttaactcggcattttttttttcacgctaatggaaagtagcggtggaagccagctgggaaagaattccaaaacaagtgatggtcgtgaaacaaaagaagttaatagcactgcgcaaaattttgttcatttcacagaagaagaggaagatattgttttcagaatgcacaggcttgtcgggaacaggtgggaacttatagctggaagaataccgggaaggacagcagaagaagtagagaagttctgggcaattaaacatcaagccacatgatagcagaaagaggatgtttgccccaaaagtag

SEQ ID NO: 326 - protein, 79 aa, Oryza sativa (japonica cultivar-group)
  G3392 polypeptide  Orthologous to G682
MESSGGSQLGKNSKTSDGRETKEVNSTAQNFVHFTEEEEDIVFRMHRLVGNRWELIAGRIPGRTAEEVEKFWAIKHQAT

SEQ ID NO: 327 - DNA, 356 bp, Oryza sativa (japonica cultivar-group)
  G3393 Predicted polypeptide sequence is orthologous to G682
cataaggtcataacaagggtctgaggatcttagctagcacaagatctcaactcggcatttcattggagtttttcacgcctaatggatagcagcagtggtagccagggaaagaattccaaaaccagtgatggttgtgaaacaaaagaagttaataacactgcacagaattttgttcatttcacggaagaagaggaagatctcgttttcagaatgcacaggcttgttgggaacaggtgggaacttatagctggaagaatccctggaagaacagcaaaagaggtagaaatgttctgggcagtaaagcaccagaatacataaggggggaaaaagggtgtatgccctaaaagtagcgtaca

SEQ ID NO: 328 - protein, 78 aa, Oryza sativa (japonica cultivar-group)
  G3393 polypeptide  Orthologous to G682
MDSSSGSQGKNSKTSDGCETKEVNNTAQNFVHFTEEEEDLVFRMHRLVGNRWELIAGRIPGRTAKEVEMFWAVKHQNT

SEQ ID NO: 329 - DNA, 1231 bp, Oryza sativa (japonica cultivar-group)
  G3394  Predicted polypeptide sequence is orthologous to G481 and G482
ggccgcttctcttctccagcgtccgatctccccctctcgcctctccgcctcacctccgctccgcttcccacccccgcttcctctctctctcctctccccccccctctctctctctctctctctctctctctcctcctcgcttcaccacctcgcgcccaacccccctctctctcctctccacgtcgcgccctctccgcgcgcgcccgcgcttctatataaggaggggggaggtgggatggcggatgggccggggagcccggggggaggaggggggagccacgagagcgggagcccgagggggggagggggaggagggggaggtgggggtggggggggcccactcgtccggcaggacaggttcctccccatcgccaacatcagccgcatcatgaagaaggccatcccggccaacgggaagatcgccaaggacgccaaggagaccgtgcaggagtgcgtctccgagttcatctccttcatcaccagcgaggcgagcgataaatgccagagggagaagcgcaagaccatcaacggcgacgacttgctgtgggcgatggccacgctgggcttcgaggactacatcgagcccctcaaggtctacctgcagaagtacagagagatggagggtgatagtaaattaactgcaaaggctggtgatggctctgtgaaaaaggatgtacttggttctcatggaggaagcagttcaagtgcccaagggatgggccaacaagcagcatacaatcaaggaatgggttatatgcaacctcagtaccataatggggatgtctcaaactgaagataggaccttttcatgcaactgttgctaggtggattttatttggtgctgcagtcgttagctaatatatatacctacacctcatggtgagcagtgaaggaagtaacttgctaccacctctaggtcccatgtttgtcaaccaggaactgatgctgcttggaagcgtcgagccaaggctgcttctcagatgtaaattactccccgtgaggatagtttcggttcgtggtctagctctgttgttgtatgtatattcaggataatttaacaattggtctttggctgtcattcggttccatataatctgtattgggaggcataaatattcatgttgtatttcgtcctgaactagcgtgttgtactattgagaaatagatgctctctgtaatggtagcaattttactctgattcccaaaaaaaaaaaaaaaaaaaaaaaaaaaa

SEQ ID NO: 330 - protein, 185 aa, Oryza sativa (japonica cultivar-group)
  G3394 polypeptide  Orthologous to G481 and G482
MADGPGSPGGGGGSHESGSPRGGGGGGGGGGGGGPLVRQDRFLPIANISRIMKKAIPANGKIAKDAKETVQECVSEFISFITSEASDKCQREKRKTINGDDLLWAMATLGFEDYIEPLKVYLQKYREMEGDSKLTAKAGDGSVKKDVLGSHGGSSSSAQGMGQQAAYNQGMGYMQPQYHNGDVSN

SEQ ID NO: 331 - DNA, 610 bp, Oryza sativa (japonica cultivar-group)
  G3395  Predicted polypeptide sequence is orthologous to G481 and G482
tggatctagggtttttggagggcggcgcggggatggcggacgcggggcacgacgagagcgggagcccgccgaggagcggcggggtgagggagcaggacaggttcctgcccatcgccaacatcagccgcatcatgaagaaggccgtcccggcgaacggcaagatcgccaaggacgccaaggagaccctgcaggagtgcgtctcggagttcatctccttcgtcaccagcgaggcgagcgacaaatgtcagaaggagaagcgcaagaccatcaacggggaagatctcctctttgcgatgggtacgcttggctttgaggagtacgttgatccgttgaagatctatttacacaagtacagagagatggagggtgatagtaagctgtcctcaaaggctggtgatggttcagtaaagaaggatacaattggtccgcacagtggcgctagtagctcaagtgcgcaagggatggttggggcttacacccaagggatgggttatatgcaacctcagtatcataatggggacacctaaagatgaggatagtgaaaattttcagtaactggtgtcctctgtgagttattatccatctgttaaggaagaacccacattagggc

SEQ ID NO: 332 - protein, 164 aa, Oryza sativa (japonica cultivar-group)
  G3395 polypeptide  Orthologous to G481 and G482
MADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREMEGDSKLSSKAGDGSVKKDTIGPHSGASSSSAQGMVGAYTQGMGYMQPQYHNGDT

SEQ ID NO: 333 - DNA, 837 bp, Oryza sativa (japonica cultivar-group)
  G3396  Predicted polypeptide sequence is orthologous to G481 and G482
gtcgagatccggcggccggtggcgtcctcctccctctccctcctccccaaccaacggcgctgatcccctccgccatctccgtccatctccgcctaaaaaaactaagcgatgtcggaggggttcgacgggacggagaacggcggcggcggcggcggaggcggagtagggaaggagcaggaccggttcctgccgatcgccaacatcggccgcatcatgcgccgggccgtgccggagaacggcaagatcgccaaggactccaaggagtccgtccaggagtgcgtctccgagttcatcagcttcatcaccagcgaagcaagcgacaagtgcctcaaggagaagcgcaagaccatcaatggggacgacctgatctggtcaatgggcacgctcggattcgaggactatgtcgagcctctcaagctctacctcaggctctaccgggagacggagggtgacacaaagggttcaagagcttctgaactgccagtaaagaaagatgttgtacttaatggagatcctggatcatcgtttgaaggcatgtaggacgaggagtgtgatagcatctaggaaggagaaccatcgtttttagggaaagaacgctccagcatcctgttatgttgtaagcaggatgcttctaaagttccaataccttgttaccacgaatgttagtcgtcgttctttttgaaatgttcttgtgttagccaggatgtccaaatttgttgtaggttctagttcagtcgtgtgttgtgtggttgtgtctaaccatatttggccgtttccggctgtcctgcatatgctaaattcagaggggtaaagagatctaagaaaaaaaaaaaaaaa

SEQ ID NO: 334 - protein, 143 aa, Oryza sativa (japonica cultivar-group)
  G3396 polypeptide  Orthologous to G481 and G482
MSEGFDGTENGGGGGGGGVGKEQDRFLPIANIGRIMRRAVPENGKIAKDSKESVQECVSEFISFITSEASDKCLKEKRKTINGDDLIWSMGTLGFEDYVEPLKLYLRLYRETEGDTKGSRASELPVKKDVVLNGDPGSSFEGM

SEQ ID NO: 335 - DNA, 720 bp, Oryza sativa (japonica cultivar-group)
  G3397 Predicted polypeptide sequence is orthologous to G481 and G482
gcgtctgatttgctgaagaggaggaggaggatgccggactcggacaacgactccggcgggccgagcaactacgcgggaggggagctgtcgtcgccgcgggagcaggacaggttcctgccgatcgcgaacgtgagcaggatcatgaagaaggcgctgccggcgaacgccaagatcagcaaggacgccaaggagacggtgcaggagtgcgtctccgagttcatctccttcatcaccggcgaggcctccgacaagtgccagcgcgagaagcgcaagaccatcaacggcgacgacctgctctgggccatgaccaccctcggcttcgaggactacgtcgaccccctcaagcactacctccacaagttccgcgagatcgagggcgagcgcgccgccgcctccaccaccggcgccggcaccagcgccgcctccaccacgccgccgcagcagcagcacaccgccaatgccgccggcggctacgccgggtacgccgccccgggagccggccccggcggcatgatgatgatgatggggcagcccatgtacggctcgccgccaccgccgccacagcagcagcagcagcaacaccaccacatggcaatgggaggaagaggcggcttcggtcatcatcccggcggcggcggcggcgggtcgtcgtcgtcgtcggggcacggtcggcaaaacaggggcgcttgacatcgctccgagacgagtagcatgcaccat

SEQ ID NO: 336 - protein, 219 aa, Oryza sativa (japonica cultivar-group)
  G3397 polypeptide  Orthologous to G481 and G482
MPDSDNDSGGPSNYAGGELSSPREQDRFLPIANVSRIMKKALPANAKISKDAKETVQECVSEFISFITGEASDKCQREKRKTINGDDLLWAMTTLGFEDYVDPLKHYLHKFREIEGERAAASTTGAGTSAASTTPPQQQHTANAAGGYAGYAAPGAGPGGMMMMMGQPMYGSPPPPPQQQQQQHHHMAMGGRGGFGHHPGGGGGGSSSSSGHGRQNRGA

SEQ ID NO: 337 - DNA, 761 bp, Oryza sativa (japonica cultivar-group)
  G3398 Predicted polypeptide sequence is orthologous to G481 and G482
cctctcctcttcgtcttcctcctcgccttcgcttcgactgcttcgatcgagggagatcgaggttgcgatgccggattcggacaacgagtcaggggggccgagcaacgcgggggagtacgcgtcggcgagggagcaggacaggttcctgccgatcgcgaacgtgagcaggatcatgaagagggcgctcccggcgaacgccaagatcagcaaggacgccaaggagacggtgcaggagtgcgtctcggagttcatctccttcatcaccggcgaggcctccgacaagtgccagcgggagaagcgcaagaccatcaacggcgacgacctcctctgggcgatgaccacgctcggcttcgaggactacatcgacccgctcaagctctacctccacaagttccgcgagctcgagggcgagaaggccatcggcgccgccggcagcggcggcggtggcgccgcctcctccggcggctccggctccggctccggctcgcaccaccaccaggatgcttcccggaacaatggcggatacggcatgtacggcggcggcggcggcatgatcatgatgatgggacagcctatgtacggctcgccgccggcgtcgtcagctgggtacgcgcagccgccgccgccccaccaccaccaccaccagatggtgatgggagggaaaggtgcgtatggccatggcggcggcggcggcggcgggccctccccgtcgtcgggatacggccggcaagacaggctatgagcttgctttcttggttggt

SEQ ID NO: 338 - protein, 224 aa, Oryza sativa (japonica cultivar-group)
  G3398 polypeptide  Orthologous to G481 and G482
MPDSDNESGGPSNAGEYASAREQDRFLPIANVSRIMKRALPANAKISKDAKETVQECVSEFISFITGEASDKCQREKRKTINGDDLLWAMTTLGFEDYIDPLKLYLHKFRELEGEKAIGAAGSGGGGAASSGGSGSGSGSHHHQDASRNNGGYGMYGGGGGMIMMMGQPMYGSPPASSAGYAQPPPPHHHHHQMVMGGKGAYGHGGGGGGGPSPSSGYGRQDRL

SEQ ID NO: 339 - DNA, 1160 bp, Oryza sativa (japonica cultivar-group)
  G3399 Predicted polypeptide sequence is orthologous to G1073
cggtgaggagcgagttgtagaggaggaggggcaccgatcaaccgggaagctggcggccgggaagtggtgggagcggccagatgacacggccatggccgggatggaccctggcgggggcggcgccggcgccggcagctcacggtacttccaccatctgctccgaccgcagcagccgtcgccgctgtcaccgctgtcgccgacatcccatgtcaagatggagcactccaagatgtcacccgacaagagccccgtgggcgagggagatcacgcgggagggagtggaagcggcggcgtcggcggtgaccaccagccgtcgtcgtcggccatggtgcccgtcgagggtggcagcggcagcgccggcggtagtggctcgggtgggccgacgcggcgcccgcgcgggcgcccgcccgggtccaagaacaagccgaagccgcccatcatcgtgacgcgcgacagcccgaacgcgctgcactcgcacgtgctcgaggtcgccggcggcgccgacgtcgtcgactgcgtggccgagtacgcccgccgccgagggcgcggcgtgtgcgtgctgagcggcggcggcgccgtcgtcaacgtggcgctgcggcagccgggcgcgtcgccgccgggcagcatggtggccacgctgcggggccggttcgagatcctatctctcacgggcacggtcctgccgcctcccgcgccacccggcgcgagcggcctcaccgtgttcctctccggcggccagggccaggtgatcggcggcagcgtggtgggcccgctggtcgccgcggggcccgtcgtcctgatggcggcctcattcgcgaacgccgtgtacgagcggctgccgctggagggcgaggaagaggaggtcgccgcgcccgccgccggaggcgaagcacaagatcaagtggcacaatcagctggacccccagggcagcaaccggcggcgtcacagtcctccggcgtgacaggaggcgacggcaccggcggcgccggtggcatgtcgctctacaacctcgccgggaatgtgggaggctatcagctccccggagacaacttcggaggttggagcggcgccggcgccggcggagtcaggccaccgttctgacccatgtcttagcatccagttcaaaaattctccaaattaagaattgcgcagtgcaggc

SEQ ID NO: 340 - protein, 336 aa, Oryza sativa (japonica cultivar-group)
  G3399 polypeptide Orthologous to G1073
MAGMDPGGGGAGAGSSRYFHHLLRPQQPSPLSPLSPTSHVKMEHSKMSPDKSPVGEGDHAGGSGSGGVGGDHQPSSSAMVPVEGGSGSAGGSGSGGPTRRPRGRPPGSKNKPKPPIIVTRDSPNALHSHVLEVAGGADVVDCVAEYARRRGRGVCVLSGGGAVVNVALRQPGASPPGSMVATLRGRFEILSLTGTVLPPPAPPGASGLTVFLSGGQGQVIGGSVVGPLVAAGPVVLMAASFANAVYERLPLEGEEEEVAAPAAGGEAQDQVAQSAGPPGQQPAASQSSGVTGGDGTGGAGGMSLYNLAGNVGGYQLPGDNFGGWSGAGAGGVRPPF

SEQ ID NO: 341 - DNA, 1143 bp, Oryza sativa (japonica cultivar-group)
  G3400 Predicted polypeptide sequence is orthologous to G1073
ctctgcaggtgaggtgaggtgaggggtgggatcgagggatcgagaagctggcggcgagcaagtggtgggagcgcgccgatgagggcgccatggccgggatggatcccaccggcggcggtggcggcggcggcgtggcggcgcactacctacacatgctccgcgcgcagcagcaccagccactgtccccggcaggtgacgtcaaggcggagcggtccatgctgtcgccggatgagagccccggcgcggacgccgacctaggatcggaccacccgacgtcgtcggccatggtggcggcggaggacagcggcggcggcagcggttcgggtggcccgatgcggcgcccccgcgggaggccgctgggctccaagaacaagcccaagccgcccatcatcgtgacgcgggacagccccaacgcgttccactcccacgtcctcgaggtcgccgcgggaaccgacatcgtcgagtgcgtctgcgagttcgcgcgccgccgcggccgcggcgtctccgtgctcagcggtggcggcgccgtcgccaacgtcgcgctccgccagccaggcgcgtcgcccccgggcagcctggtcgccaccatgcgcggccagttcgagatcctgtccctcacgggcaccgtcctcccgccgcccgcgccgcccagcgccagcggcctcaccgtcttcctctccggcgggcagggccaggtggtcggcgggagcgtggccggccagctcatcgccgcggggccagtcttcctcatggccgcctcgttcgccaatgccgtctacgagcgtctgccactcgatggggaggatccggaggcagaggctgccgccgccacccctcccggcgatgcggcgcagccaaccggcccaccaccaccgcagcagcagcccacagcctcgcagtcctctgaggtgaccgccggtgacggcggcggcggcggcggtctcggcatgtatcttggaggccatgtgggatcctaccagcagcagcagcagcaacttcccggaccaggagacaacttcggtagctggagcggcagcatcaggccgccgccattctgatccaaacacctcaaatcaagctctcccccaacaacgccatgcatgtctaaatcctcacaagattcactccaagaagacgaagctg

SEQ ID NO: 342 - protein, 322 aa, Oryza sativa (japonica cultivar-group)
  G3400 polypeptide  Orthologous to G1073
MAGMDPTGGGGGGGVAAHYLHMLRAQQHQPLSPAGDVKAERSMLSPDESPGADADLGSDHPTSSAMVAAEDSGGGSGSGGPMRRPRGRPLGSKNKPKPPIIVTRDSPNAFHSHVLEVAAGTDIVECVCEFARRRGRGVSVLSGGGAVANVALRQPGASPPGSLVATMRGQFEILSLTGTVLPPPAPPSASGLTVFLSGGQGQVVGGSVAGQLIAAGPVFLMAASFANAVYERLPLDGEDPEAEAAAATPPGDAAQPTGPPPPQQQPTASQSSEVTAGDGGGGGGLGMYLGGHVGSYQQQQQQLPGPGDNFGSWSGSIRPPPF

SEQ ID NO: 343 - DNA, 1003 bp, Oryza sativa (japonica cultivar-group)
  G3401 Predicted polypeptide sequence is orthologous to G1073
ggatatataggccgcaggtagaagctggcgagccggtggtgggacgaggggcggctcagcctgccggtgacagccgccgacccatccctcggccttggcaacaacgacaccaccggcgccggtgacgacgacatggcgtccaaggagccaagcggcgaccacgaccacgagatgaacgggaccagcgccgggggcggcgagcccaaggacggcgcggtggtgaccggccgcaaccggcgcccccgcggacggccgccgggctccaagaacaagcccaagccgcccatcttcgtgacgcgggacagcccgaacgcgctgcgcagccacgtcatggaggtggccggcggcgccgatgtcgccgagtccatcgcgcacttcgcgcggcggcggcagcgcggcgtctgcgtgctcagcggggccggcaccgtgaccgacgtggccctgcgccagccggccgcgccgagcgccgtggtggcgctccgtgggcggttcgagatcctgtccctgacggggacgttcctgccggggccggcgccgccgggctccaccgggctgaccgtgtacctcgccggcgggcaggggcaggtggtgggcggcagcgtggtggggacgctcaccgcggcggggccggtcatggtgatcgcctccaccttcgccaacgccacctacgagaggctgccgctggatcaggaggaggaggaagcagcggcaggcggcatgatggcgccgccgccactcatggccggcgccgccgatccactacttttcggcgggggaatgcacgacgccgggcttgctgcatggcaccatgcccgccctccgccgccgccgccctactagctctctagctagattaattaattaagcttcatgaattaaatccttgcttaattaattggcatatatatatactcacatgatatatatgatcaacaagctatatatagctagccagctcgagctaattaattaacaaaaggtgagccaatataatgcaagatcg

SEQ ID NO: 344 - protein, 235 aa, Oryza sativa (japonica cultivar-group)
  G3401 polypeptide  Orthologous to G1073
MASKEPSGDHDHEMNGTSAGGGEPKDGAVVTGRNRRPRGRPPGSKNKPKPPIFVTRDSPNALRSHVMEVAGGADVAESIAHFARRRQRGVCVLSGAGTVTDVALRQPAAPSAVVALRGRFEILSLTGTFLPGPAPPGSTGLTVYLAGGQGQVVGGSVVGTLTAAGPVMVIASTFANATYERLPLDQEEEEAAAGGMMAPPPLMAGAADPLLFGGGMHDAGLAAWHHARPPPPPPY

SEQ ID NO: 345 - DNA, 902 bp, Oryza sativa (japonica cultivar-group)
  G3403 Predicted polypeptide sequence is orthologous to G1073
tcgaccagtgcattaattgtgcttctcctggagcagggtcaagctggcgaacaggtcgtggtggtcgggccccatgggcttgccggagcagccgtccggctcgtcgggccccaaggcggagctcccggtggccaaggagccggaggcgagcccgacggggggcgcggcggcggaccacgccgacgagaacaacgaatccggcggcggcgagccgcgggagggcgccgtggtggcggcgcccaaccggcgcccccgcggccgcccgccgggctccaagaacaagccgaagccgcccatcttcgtgacgcgcgacagccccaacgcgctgcgcagccacgtcatggaggtggccggcggcgccgacgtcgccgacgccatcgcgcagttctcgcgccgccgccagcgcggcgtctgcgtgctcagcggcgccgggacggtcgccaacgtcgcgctgcgccagccgtcggcgcccggcgccgtcgtcgccctgcacggccgcttcgagatcctctccctcaccggcaccttcctccccggcccggcgcctccgggctccacggggctcaccgtctacctcgccggcggccagggccaggttgtcggcggcagcgtcgtggggtcgctcatcgccgcgggcccggtcatggtgatcgcgtccacgttcgccaacgccacctacgagcgcctgccattggaggaagaagaggagggctcaggcccgcccatgcccggcggcgccgagcccctcatggccggcggccacggcatcgccgacccttcggcgctgccaatgttcaacctgccgccgagcaacgggctcggcggcggcggcgacggtttcccatgggcggcgcacccccgcccaccgtactgatcgatggcaatagcatggaagattcatt

SEQ ID NO: 346 - protein, 266 aa, Oryza sativa (japonica cultivar-group)
  G3403 polypeptide Orthologous to G1073
MGLPEQPSGSSGPKAELPVAKEPEASPTGGAAADHADENNESGGGEPREGAVVAAPNRRPRGRPPGSKNKPKPPIFVTRDSPNALRSHVMEVAGGADVADAIAQFSRRRQRGVCVLSGAGTVANVALRQPSAPGAVVALHGRFEILSLTGTFLPGPAPPGSTGLTVYLAGGQGQVVGGSVVGSLIAAGPVMVIASTFANATYERLPLEEEEEGSGPPMPGGAEPLMAGGHGIADPSALPMFNLPPSNGLGGGGDGFPWAAHPRPPY

SEQ ID NO: 347 - DNA, 1152 bp, Oryza sativa (japonica cultivar-group)
  G3404 Functionally related and homologous to G1073
accgtgagagagggagacagatggatccggtgacggcggcggcggcgcatgggggtgggcaccaccaccaccaccacttcggagcgccaccggtggcggcgttccaccaccacccgttccaccacggcggcggggcgcactacccggcggcgttccagcagtttcaggaggagcagcagcagcttgtggcggcggcggcggcggctggtgggatggcgaagcaggagctggtggatgagagcaacaacaccatcaacagcggcgggagcaacgggagcggcggggaggagcagaggcagcagtccggggaggagcagcaccagcaaggggcggcggcgccggtggtgatccggcgtcccaggggccgccccgccggctccaagaacaagcccaagcctccggtcatcatcacgcgcgacagcgccagcgcgctgcgggcgcacgtcctcgaggtcgcctccgggtgcgacctcgtcgacagcgtcgccacgttcgcgcgccgccgccaggtcggtgtctgcgtgctcagcgccaccggcgccgtcaccaacgtctccgtccggcagcccggcgcgggccccggcgccgtcgtcaacctcaccggccgcttcgacatcctctcgctgtccggctccttcctcccgccgccggcgcctccctccgccaccggcctcaccgtctacgtctccggcggccaggggcaggtcgtgggcggcacggtcgccggaccgctcatcgccgtcggccccgtcgtcatcatggccgcctcgttcgggaacgccgcctacgagcgcctcccgctcgaggacgacgagccgccgcagcacatggcgggcggcggccagtcctcgccgccgccgccgccgctgccattaccaccacaccagcagccgattcttcaagaccatctgccacacaacctgatgaacggaatccacctccccggcgacgccgcctacggctggaccagcggcggcggcggcggcggccgcgcggcgccgtactgatcaacatcgatctcgccggagagaaaaaaaatggaggagaaggatcggagcgagccgtgcatggtgtaggatgaattaagctaagagttaatttcttcttccgcctttgctaatcatgatgctctcgtgttgtttaatctgtggc

SEQ ID NO: 348 - protein, 328 aa, Oryza sativa (japonica cultivar-group)
  G3404 polypeptide  Functionally related and homologous to G1073
MDPVTAAAAHGGGHHHHHHFGAPPVAAFHHHPFHHGGGAHYPAAFQQFQEEQQQLVAAAAAAGGMAKQELVDESNNTINSGGSNGSGGEEQRQQSGEEQHQQGAAAPVVIRRPRGRPAGSKNKPKPPVIITRDSASALRAHVLEVASGCDLVDSVATFARRRQVGVCVLSATGAVTNVSVRQPGAGPGAVVNLTGRFDILSLSGSFLPPPAPPSATGLTVYVSGGQGQVVGGTVAGPLIAVGPVVIMAASFGNAAYERLPLEDDEPPQHMAGGGQSSPPPPPLPLPPHQQPILQDHLPHNLMNGIHLPGDAAYGWTSGGGGGGRAAPY

SEQ ID NO: 349 - DNA, 1013 bp, Oryza sativa (japonica cultivar-group)
  G3405 Functionally related and homologous to G1073
ctagctaattgattgctagcttgcaaggatggatccggtcacggcatcaatacacggtcaccatcttcctccaccgttcaacacccgcgacttccatcaccatctccagcagcagcagcaccagctgcatctcaagaccgaggatgaccaaggcggcggcactccgggtgtcttcggcagccgcggcaccaagcgcgaccacgacgacgacgagaacagtggcaacggccatggaagcggtggtgacggcggtgacctcgcgctggtacccccctcgggtggcgggccggacggcgccgggagcgagagcgccacgcgccgcccgaggggacgcccggcggggtccaagaacaagccgaagccaccgatcatcatcaccagggacagcgccaacacgctccggacgcacgtcatggaggtggccggcggctgcgacatctccgagagcatcaccacgttcgcgcgacgccggcagcgcggggtttgcgtgctcagcggcgccggcaccgtcactaacgtcacgctgcggcagcccgcatcgcagggagcggtcgttgcgctccacggccggttcgagatactctccctctccggctccttcctcccgccgcccgccccgccggaggccacggggctcaccgtctacctggccggaggccagggccaggtcgtgggcggcagcgtcgtcggcgcgctgaccgcggctgggcctgtggtgataatggcggcgtcttttgcgaacgcggtgtacgagcggctgccgttggaggacgacgagctactggcggctcaagggcaagccgacagcgctgggttgctcgccgcggggcagcaagcggcgcagctcgccggcggggccgtcgatccaagcctcttccaaggactaccaccaaacctactcggaaacgtgcagctgccgccggaagccgcctacggatggaaccctggagccggcggtggccgcccggcgccgttctgagatggatcgattccgcgacagcaacgcagcatag

SEQ ID NO: 350 - protein, 316 aa, Oryza sativa (japonica cultivar-group)
  G3405 polypeptide  Functionally related and homologous to G1073
MDPVTASIHGHHLPPPFNTRDFHHHLQQQQHQLHLKTEDDQGGGTPGVFGSRGTKRDHDDDENSGNGHGSGGDGGDLALVPPSGGGPDGAGSESATRRPRGRPAGSKNKPKPPIIITRDSANTLRTHVMEVAGGCDISESITTFARRRQRGVCVLSGAGTVTNVTLRQPASQGAVVALHGRFEILSLSGSFLPPPAPPEATGLTVYLAGGQGQVVGGSVVGALTAAGPVVIMAASFANAVYERLPLEDDELLAAQGQADSAGLLAAGQQAAQLAGGAVDPSLFQGLPPNLLGNVQLPPEAAYGWNPGAGGGRPAPF

SEQ ID NO: 351 - DNA, 918 bp, Oryza sativa (japonica cultivar-group)
  G3406 Functionally related and homologous to G1073
atggcaggtctcgacctcggcaccgccgcgacgcgctacgtccaccagctccaccacctccaccccgacctccagctgcagcacagctacgccaagcagcacgagccgtccgacgacgaccccaacggcagcggcggcggcggcaacagcaacggcgggccgtacggggaccatgacggcgggtcctcgtcgtcaggtcctgccaccgacggcgcggtcggcgggcccggcgacgtggtggcgcgccggccgcgggggcgcccgcctggctccaagaacaagccgaagccgccggtgatcatcacgcgggagagcgccaacacgctgcgcgcccacatcctggaggtcgggagcggctgcgacgtgttcgagtgcgtctccacgtacgcgcgccggcggcagcgcggcgtgtgcgtgctgagcggcagcggcgtggtcaccaacgtgacgctgcgtcagccgtcggcgcccgcgggcgccgtcgtgtcgctgcacgggaggttcgagatcctgtcgctctcgggctccttcctcccgccgccggctccccccggcgccaccagcctcaccatcttcctcgccgggggccagggacaggtcgtcggcggcaacgtcgtcggcgcgctctacgccgcgggcccggtcatcgtcatcgcggcgtccttcgccaacgtcgcctacgagcgcctcccactggaggaggaggaggcgccgccgccgcaggccggcctgcagatgcagcagcccggcggcggcgccgatgctggtggcatgggtggcgcgttcccgccggacccgtctgccgccggcctcccgttcttcaacctgccgctcaacaacatgcccggtggcggcggctcacagctccctcccggcgccgacggccatggctgggccggcgcacggccaccgttctga

SEQ ID NO: 352 - protein, 305 aa, Oryza sativa (japonica cultivar-group)
  G3406 polypeptide  Functionally related and homologous to G1073
MAGLDLGTAATRYVHQLHHLHPDLQLQHSYAKQHEPSDDDPNGSGGGGNSNGGPYGDHDGGSSSSGPATDGAVGGPGDVVARRPRGRPPGSKNKPKPPVIITRESANTLRAHILEVGSGCDVFECVSTYARRRQRGVCVLSGSGVVTNVTLRQPSAPAGAVVSLHGRFEILSLSGSFLPPPAPPGATSLTIFLAGGQGQVVGGNVVGALYAAGPVIVIAASFANVAYERLPLEEEEAPPPQAGLQMQQPGGGADAGGMGGAFPPDPSAAGLPFFNLPLNNMPGGGGSQLPPGADGHGWAGARPPF

SEQ ID NO: 353 - DNA, 987 bp, Oryza sativa (japonica cultivar-group)
  G3407 Functionally related and homologous to G1073
tcatcatcatcatcacttgcatatcgaattattaataatatcgaagatggcaggccttgatttgggcaccagctacctccaccaccaccaatcactgcatctccgccacgacgatggcggcgccggctccgacgacggcggccacgacgacctctcgccggggagcggcggtggcggcgggcccagcagcacggccggtggcgccgggatcggcggcggcgaggtcgtcgctcgccgcccccgcggccgcccgccgggctccaagaacaagcccaagccgccggtgatcatcaccagggagagcgccaacgcgctcagggcgcatatcctcgaggtagccgccggttgcgatgtgttcgaggcgctgacggcgtacgcgcgccgccggcagcgcggggtgtgcgtgctctcggcggcggggacagtggcgaacgtcacgctccggcagccgcagtcggcgcagcccgggccggcctcgccggcggtggcgacgctgcacggcaggttcgagatactctccctcgcgggctccttcctgcccccgcccgcgccgccgggcgccaccagcctcgccgcgttcctcgccggcgggcaggggcaggtcgtcggtggcagcgtcgccggcgcgctcatcgcggcggggcccgtcgtcgtcgtcgccgcgtcgttcagcaacgtggcgtacgagaggctgccgctcgaggacggcgacgaggtggtccccccggcgccggcagggagcgaccagggcggcggcggcagcggcggcatgccaccattaggcgttgatccgtcgggcggcgccgccaccggtgggctcccgttcttcaacatgccgttcgggatgccgccaatgccggtggacggccacgccggctggcctggcgccggcgtcgggaggccaccgttctcatgatggatggatccccatattccggcgagcggccggcggcgaggtggtcggcaagattgaagacatggacatgg

SEQ ID NO: 354 - protein, 289 aa, Oryza sativa (japonica cultivar-group)
  G3407 polypeptide  Functionally related and homologous to G1073
MAGLDLGTSYLHHHQSLHLRHDDGGAGSDDGGHDDLSPGSGGGGGPSSTAGGAGIGGGEVVARRPRGRPPGSKNKPKPPVIITRESANALRAHILEVAAGCDVFEALTAYARRRQRGVCVLSAAGTVANVTLRQPQSAQPGPASPAVATLHGRFEILSLAGSFLPPPAPPGATSLAAFLAGGQGQVVGGSVAGALIAAGPVVVVAASFSNVAYERLPLEDGDEVVPPAPAGSDQGGGGSGGMPPLGVDPSGGAATGGLPFFNMPFGMPPMPVDGHAGWPGAGVGRPPFS

SEQ ID NO: 355 - DNA, 1064 bp, Oryza sativa (japonica cultivar-group)
  G3408 Functionally related and homologous to G1073
gtggttttggttgattgctactctgtgccatgtcgttctgcgagagggacatgaacaaggagagcatgtaccaagaacgggacgacatggcggggatacggttcgcgacgccgccgctgcctcagcagcagcagcagcagcagctggtggagtgcttctccgacgaggtggacagccgcgggagtggcggcgagatgaaggatgccgtggggagcgggagtgggcagctggtcgttgttggtggcggggatggggcgagcatcgaggtggcgaagaagaggagggggaggccgccggggtccaagaacaagccgaagccacccgtggtgatcacgcgggaggcggagccggcggcggcgatgcggccgcacgtgatcgagatccccggcgggcgggacgtcgcggaggcgctcgcgcggttctcgagccgtcggaacctcgggatctgcgtgctcgccggcaccggcgcggtcgccaacgtgtcgctccgccacccgtcacccggggtcccgggctcagctccggctgcgatcgtgttccacggccggtacgagatcctctccctgtcggccacgttcctgcctccggccatgtcctccgtggcgccccaggccgcggtcgccgccgcgggcctctccatctcgctcgccggcccgcacggccagatcgtcggcggggccgtggcaggcccgctctacgccgcgaccaccgtcgtggtcgtcgccgccgccttcaccaaccccaccttccaccgcctccccgccgacgacgacgcgtcggtgtccgtctcggtgtcactctccggcagcggcgacgcggacgaacaccggggccaccagcacaaacctgagccgcaagaaccgcgccaacttcgacggccgccaccgcacctgtcagcagccgccgccgtctcagcagcacagccggtggagccatgcggcgcgcccatgtacgcctgccaccctcagccacaggaggtgatgtggccgccgccggctcgtacgccgcacccgccgccgccgccgccgtactaatccgaccgaattggtacgccattgccacat

SEQ ID NO: 356 - protein, 334 aa, Oryza sativa (japonica cultivar-group)
  G3408 polypeptide  Functionally related and homologous to G1073
MSFCERDMNKESMYQERDDMAGIRFATPPLPQQQQQQQLVECFSDEVDSRGSGGEMKDAVGSGSGQLVVVGGGDGASIEVAKKRRGRPPGSKNKPKPPVVITREAEPAAAMRPHVIEIPGGRDVAEALARFSSRRNLGICVLAGTGAVANVSLRHPSPGVPGSAPAAIVFHGRYEILSLSATFLPPAMSSVAPQAAVAAAGLSISLAGPHGQIVGGAVAGPLYAATTVVVVAAAFTNPTFHRLPADDDASVSVSVSLSGSGDADEHRGHQHKPEPQEPRQLRRPPPHLSAAAAVSAAQPVEPCGAPMYACHPQPQEVMWPPPARTPHPPPPPPY

SEQ ID NO: 357 - DNA, 920 bp, Oryza sativa (japonica cultivar-group)
  G3429 Predicted polypeptide sequence is orthologous to G481 and G482
ccaggtcattgagacttgagagacatggcagggaacaaaaagcgtggtatagtagtatagtcagtactaggattagtacttgataactagcacaacaaaaagctactatcatttttgcattcaaagtggtaattaagaatcggatgatcattttgattgttcctcttcatttgttttggatgtcaggtggcaggaacatggatcaggtcaagaaggcggcagtgagatcggatggggtgggaggtagtgcgaccaacgccgagctgccgatggccaacctcgtacgcctgataaagaaggtgctcccagggaaagcgaagatcgggggagcagccaagggtctcacccatgattgcgcggtggagttcgtcgggttcgtcggcgacgaggcctccgagaaggccaaggcagagcaccgccgcaccgtagcgccggaagactacttgggctcattcggcgaccttggcttcgatcgctacgtcgaccccatggatgcctacatccatggttaccgtgagtttgagagggctggtgggaataggagggtggcgccgcctcctccggcggcagctacaccgctgacgcccggtggaccgacattcactgacgcagagctgcagtttctccggtcggtgatcccctccagaagtgatgatgaatatagcggctcatcaccagccataggcggctatggctatggatatggctatggaaaaaatatgtgaacaacttgatgcatgtgtgtgtgtacactgcatgcatgcgtggagggtcaaacagagtcaagactcttgtggtggtttcaataagtctctagtgacaatataagttgtgtatcgttgtttcctttgtaaaaaaaaaaacgtcatgtatcgttgtgtgtcctcatccggtaatcctttacgtgggtgggttatggc

SEQ ID NO: 358 - protein, 193 aa, Oryza sativa (japonica cultivar-group)
  G3429 polypeptide  Orthologous to G481 and G482
MIILIVPLHLFWMSGGRNMDQVKKAAVRSDGVGGSATNAELPMANLVRLIKKVLPGKAKIGGAAKGLTHDCAVEFVGFVGDEASEKAKAEHRRTVAPEDYLGSFGDLGFDRYVDPMDAYIHGYREFERAGGNRRVAPPPPAAATPLTPGGPTFTDAELQFLRSVIPSRSDDEYSGSSPAIGGYGYGYGYGKNM

SEQ ID NO: 359 - DNA, 257 bp, Zea mays
  G3431 Predicted polypeptide sequence is orthologous to G682
ctaatggatagcagcagtggtagccaggacaagaaattcagagacaatgatcgccctgaagcaaaagaagctaatagcaccgcacagcatcttgttgacttcacggaagcagaggaagatcttgtttccagaatgcacaggcttgtggggaacaggtgggagattatagcaggaagaatcccaggaaggacagcagaagaggtagagatgttctggtccaaaaaataccaggaaagatgaaaccgaggccttagatt

SEQ ID NO: 360 - protein, 78 aa, Zea mays
  G3431 polypeptide  Orthologous to G682
MDSSSGSQDKKFRDNDRPEAKEANSTAQHLVDFTEAEEDLVSRMHRLVGNRWEIIAGRIPGRTAEEVEMFWSKKYQER

SEQ ID NO: 361 - DNA, 819 bp, Zea mays
  G3434  Predicted polypeptide sequence is orthologous to G481 and G482
tcgacaagggttgcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacagtaccacaatggggaaacctaacaaagggctaatacagcagcaatttatgctagggaagtctctgcattgcttaccatgtgtattggcagaaaacaggaggcacttacaaagggtgttaatctctgcgatggctgcctctcaggtgtaaattggcttcggtttagcgctgcttttgtccgtatatttaggatgatttgactgttgctacttttggcaaccttttacatttacagatatgtattattcagcataaatataatatagtagtcctaggcctaaataatggtgattaaaaaaaaaaaaaaaa

SEQ ID NO: 362 - protein, 164 aa, Zea mays
  G3434 polypeptide  Orthologous to G481 and G482
MADDGGSHEGSGGGGGVREQDRFLPIANISRIMKKAVPANGKIAKDAKETLQECVSEFISFVTSEASDKCQKEKRKTINGDDLLWAMATLGFEEYVEPLKIYLQKYKEMEGDSKLSTKAGEGSVKKDAISPHGGTSSSSNQLVQHGVYNQGMGYMQPQYHNGET

SEQ ID NO: 363 - DNA, 735 bp, Zea mays
  G3435 Predicted polypeptide sequence is orthologous to G481 and G482
cggcggtggccttgagctgaggcggcggagcgatgccggactcggacaacgactccggcgggccgagcaacgccgggggcgagctgtcgtcgccgcgggagcaggaccggttcctgcccatcgccaacgtgagccggatcatgaagaaggcgctcccggccaacgccaagatcagcaaggacgccaaggagacggtgcaggagtgcgtgtccgagttcatctccttcatcaccggcgaggcctccgacaagtgccagcgcgagaagcgcaagaccatcaacggcgacgacctgctgtgggccatgaccacgctcggcttcgaggactacgtcgagccgctcaagcactacctgcacaagttccgcgagatcgagggcgagagggccgccgcgtccgccggcgcctcgggctcgcagcagcagcagcagcagggcgagctgcccagaggcgccgccaatgccgccgggtacgccgggtacggcgcgcctggctccggcggcatgatgatgatgatgatggggcagcccatgtacggcggctcgcagccgcagcaacagccgccgccgcctcagccgccacagcagcagcagcaacatcaacagcatcacatggcaataggaggcagaggaggattcggccaacaaggcggcggcggcggctcctcgtcgtcgtcagggcttggccggcaagacagggcgtgagttgcgacgatacgtcagaatcagaatcgctgat

SEQ ID NO: 364 - protein, 222 aa, Zea mays
  G3435 polypeptide  Orthologous to G481 and G482
MPDSDNDSGGPSNAGGELSSPREQDRFLPIANVSRIMKKALPANAKISKDAKETVQECVSEFISFITGEASDKCQREKRKTINGDDLLWAMTTLGFEDYVEPLKHYLHKFREIEGERAAASAGASGSQQQQQQGELPRGAANAAGYAGYGAPGSGGMMMMMMGQPMYGGSQPQQQPPPPQPPQQQQQHQQHHMAIGGRGGFGQQGGGGGSSSSSGLGRQDRA

SEQ ID NO: 365 - DNA, 803 bp, Zea mays
  G3436 Predicted polypeptide sequence is orthologous to G481 and G482
tttgacttgaccggacagtgctgttcggtggctcggccgcgatgccggactccgacaacgagtccggcgggccgagcaacgcggagttctcgtcgccgcgggagcaggaccggttcctgccgatcgcgaacgtgagccggatcatgaagaaggcgctcccggccaacgccaagatctccaaggacgccaaggagacggtgcaggagtgcgtgtcggagttcatctccttcatcaccggcgaggcctccgacaagtgccagcgcgagaagcgcaagaccatcaacggcgacgacctactctgggccatgaccacgctcggcttcgaggactacgtcgagccgctcaagctctacctccacaagttccgcgagctcgagggcgagaaggcggccacgacgagcgcctcctccggcccgcagccgccgctgcacagggagacgacgccgtcgtcgtcaacgcacaatggcgcgggcgggcccgtcgggggatacggcatgtacggcggcgcgggcgggggaagcggtatgatcatgatgatgggacagcccatgtacggcggctccccgccggccgcgtcgtccgggtcgtacccgcaccaccagatggccatgggcggaaaaggtggcgcctatggctacggcggaggctcgtcgtcgtcgccgtcagggctcggcaggtaggacaggttgtgaccgtcgccgtccatgcttgcatggccatggccatggcatggctcccgccgccggcttcttgcttggtgtcggtaattagcgctggtggcctgcgctggttaagttcaccat

SEQ ID NO: 366 - protein, 212 aa, Zea mays
  G3436 polypeptide  Orthologous to G481 and G482
MPDSDNESGGPSNAEFSSPREQDRFLPIANVSRIMKKALPANAKISKDAKETVQECVSEFISFITGEASDKCQREKRKTINGDDLLWAMTTLGFEDYVEPLKLYLHKFRELEGEKAATTSASSGPQPPLHRETTPSSSTHNGAGGPVGGYGMYGGAGGGSGMIMMMGQPMYGGSPPAASSGSYPHHQMAMGGKGGAYGYGGGSSSSPSGLGR

SEQ ID NO: 367 - DNA, 1322 bp, Zea mays
  G3437 Predicted polypeptide sequence is orthologous to G481 and G482
tattgtctatgagggaagcagatcctctacgctgcaattgggccactgacatgtgggaccaggtctagattggacccacacatcaatgaccgaaatgcagaagagggtctcgttgccactgtaagctatctcctagagttcagagcagggcaagaatcttgcaatgctcacatgaacataatataatcgttgtgttagctatgcgtcggcatcactaccgtcctcccactggcatctcccgtctactattttgggacgaacagaacagagacactagctaactagcttattagcttgctcccctccttcctttcaagctttaaaaggagaccatctcttgcaccacctcttcatccatccggccaagcaaggggcatgaagaacaggaagggctacgggcaccagggccacctgctgagccccgtgggcagcccgctgtcggacaacgagtccggcgccgcggcagcggccggcggcggcgggtgcgggagcagcgtggggtactgcggcggcggcggcggtgagtcgccggccaaggagcaagaccggttcctgccgatcgccaacgtgtcgcgcatcatgaagcgctccctgccggcgaacgccaagatctccaaggaggccaaggagacggtgcaggagtgcgtgtccgagttcatcagcttcgtcacgggggaggcctccgacaagtgccagcgcgagaagcgcaagaccatcaacggcgacgacctgctctgggccatgaccacgctcggcttcgaggcctacgtcgccccgctcaagtcctacctcaaccgctaccgcgaggccgagggcgagaaggccgccgtgctcggcggcggcgcgcgccacggcgacggcgcggcgcggcggacgacgccggcccactcgccgcgcaatggcgcgggcgggcccgtcgggggatacggcatgtacggcggcgcgggcgggggaagcggtatgatcatgatgatggggcagcccatgtacggcggctccccgccggccgcgtcgtccgggtcgtacccgcaccaccagatggccatgggcggaaaaggtggcgcctatggctacggcggaggctcgtcgtcgtcgccgtcagggctcggcaggtaggccaggttgtgaccgtcgccgtccatgcttgcatggccatggcatggctcagtcccgccgccggcttcttgcttggtgtcggtaattagcgctggttaagttaaccttcggtttttccccccttttcttttcgtggtaagtaatgttgtgctgaatggagccagtgatatggttaagatagctccataacctctcggtaaaaaaaa

SEQ ID NO: 368 - protein, 246 aa, Zea mays
  G3437 polypeptide  Orthologous to G481 and G482
MKNRKGYGHQGHLLSPVGSPLSDNESGAAAAAGGGGCGSSVGYCGGGGGESPAKEQDRFLPIANVSRIMKRSLPANAKISKEAKETVQECVSEFISFVTGEASDKCQREKRKTINGDDLLWAMTTLGFEAYVAPLKSYLNRYREAEGEKAAVLGGGARHGDGAARRTTPAHSPRNGAGGPVGGYGMYGGAGGGSGMIMMMGQPMYGGSPPAASSGSYPHHQMAMGGKGGAYGYGGGSSSSPSGLGR

SEQ ID NO: 369 - DNA, 268 bp, Zea mays
  G3444 Predicted polypeptide sequence is orthologous to G682
cctaacccctctaatggatagcagcagtggtagccaggacaagaaattcagagacaatgatcgccctgaagcaaaagaagctaatagcaccgcacagcatcttgttgacttcacggaagcagaggaagatcttgtttccagaatgcacaggcttgtggggaacaggtgggagattatagcaggaagaatcccaggaaggacagcagaagaggtagagatgttctggtccaaaaaataccaggaaagatgaaaccgaggccttagattt

SEQ ID NO: 370 - protein, 78 aa, Zea mays; identical to SEQ ID NO: 360
  G3444 polypeptide  Orthologous to G682

SEQ ID NO: 371 - DNA, 302 bp, Glycine max
  G3445 Predicted polypeptide sequence is orthologous to G682
agaacttgttattgcaatgactgacatagatcgctcctctgataatgtttcttctgattctattgagaaatcaagccaagtttctgatgttgaattttctgaagctgaggaaatccttattgccatggtgtataatctggttggagaaaggtggtctttgattgctggaagaattcctggaagaactgcagaagaaatagagaaatattggacttcaagattttcgactagccaatgaagtggcagaaattaaacgaagcaagacaattttgggtgcctgcaactcattatacagtgactta

SEQ ID NO: 372 - protein, 73 aa, Glycine max
  G3445 polypeptide  Orthologous to G682
MTDIDRSSDNVSSDSIEKSSQVSDVEFSEAEEILIAMVYNLVGERWSLIAGRIPGRTAEEIEKYWTSRFSTSQ

SEQ ID NO: 373 - DNA, 257 bp, Glycine max
  G3446 Predicted polypeptide sequence is orthologous to G682
gagaacttgttatgcaatggctgacatagatcgctcctttgataataatgtttctgctgtttctactgagaaatcaagccaagtttcagatgttgaattttctgaagctgaggaaatccttattgccatggtgtataatctggttggggagaggtggtctttgattgctggaagaattcctggaagaactgcagaagagatagagaaatattggacttcaagattttcgactagccaatgatcggtggcagaaaacg

SEQ ID NO: 374 - protein, 74 aa, Glycine max
  G3446 polypeptide  Orthologous to G682
MADIDRSFDNNVSAVSTEKSSQVSDVEFSEAEEILIAMVYNLVGERWSLIAGRIPGRTAEEIEKYWTSRFSTSQ

SEQ ID NO: 375 - DNA, 250 bp, Glycine max
  G3447 Predicted polypeptide sequence is orthologous to G682
gttattgcaatggctgacatagatcgctcctttgataataatgtttctgctgtttctactgagaaatcaagccaagtttcagatgttgaattttctgaagctgaggaaatccttattgccatggtgtataatctggttggggagaggtggtctttgattgctggaagaattcctggaagaactgcagaagagatagagaaatattggacttcaagattttcgactagccaatgatcggtggcagaaaacg

SEQ ID NO: 376 - protein, 74 aa, Glycine max; identical to SEQ ID NO: 374
  G3447 polypeptide  Orthologous to G682

SEQ ID NO: 377 - DNA, 264 bp, Glycine max
  G3448 Predicted polypeptide sequence is orthologous to G682
attctccacgcctccttgcaatggctgactcggatctctcttcaagtcaaatttctacacattctactgattcaggaaatcgagggtcttccaaagttgaattttctgaagatgaggaaaccctcatcatcaggatgtataaactggtaggggagaggtggtctataattgctggaaggattcctggaagaacagcagaggaaatagagaagtattggacttcaagattctcgggctctagtgaatgaagctccggagtactac

SEQ ID NO: 378 - protein, 75 aa, Glycine max
  G3448 polypeptide  Orthologous to G682
MADSDLSSSQISTHSTDSGNRGSSKVEFSEDEETLIIRMYKLVGERWSIIAGRIPGRTAEEIEKYWTSRFSGSSE

SEQ ID NO: 379 - DNA, 268 bp, Glycine max
  G3449 Predicted polypeptide sequence is orthologous to G682
actcttctagctccttgcaatggctgactcggatcgctcttctagtgaagtttctacacattctactgattcagggaagcgagggtcttccaaagttgaattttctgaagatgaggaaactcttatcatcaggatgtataaactggtaggggagaggtggtctttaattgctggaaggattcctggaagaacagcagaggaaatagagaagtattggacttcaagattctcaggttctagtgaatgaggtgccaagagttctactacc

SEQ ID NO: 380 - protein, 75 aa, Glycine max
  G3449 polypeptide  Orthologous to G682
MADSDRSSSEVSTHSTDSGKRGSSKVEFSEDEETLIIRMYKLVGERWSLIAGRIPGRTAEEIEKYWTSRFSGSSE

SEQ ID NO: 381 - DNA, 285 bp, Glycine max
  G3450 Predicted polypeptide sequence is orthologous to G682
cagctcagaaggcaaagatagatccatgtccaccaccgcaactacaacctctgaagaagttagcagcaatgagtggaaagtcatacacatgagcgagcaagaggaggatctcattcgcaggatgtacaagctagtcggggacaagtggaatttgatagctggtcgcattcccggtcgtaaagcagaagaaatagagagattctggattatgagacacggcgatgctttttctgttaaaagaaacggaagtaaaacccaagactcgtgattttctctggtcatgta

SEQ ID NO: 382 - protein, 80 aa, Glycine max
  G3450 polypeptide  Orthologous to G682
MSTTATTTSEEVSSNEWKVIHMSEQEEDLIRRMYKLVGDKWNLIAGRIPGRKAEEIERFWIMRHGDAFSVKRNGSKTQDS

SEQ ID NO: 383 - DNA, 869 bp, Glycine max
  G3456 Predicted polypeptide sequence is orthologous to G1073
tcgacaacttcaacttttgttatggccaaccggtggtggaccgggtcggtgggtctagagaactctggccactcgatgaaaaaaccggatctggggttttccatgaacgagagtacggtgacggggaaccatataggagaagaagatgaggacagagaaaacagcgacgagccaagagagggagctattgacgtcgccaccacgcgccgccctaggggacgtccaccgggctccagaaacaagccgaaaccgccgatattcgtcacccgagacagccctaacgcgctgcggagccacgtcatggagattgccgtcggagccgacatcgccgactgcgtggcgcagttcgctcggaggcgccagcgcggggtttccattctcagcggcagcgggaccgtcgtcaacgtcaatctccggcaacccacggcacccggcgccgtcatggcgctccacggccgcttcgacatcctctccctcaccggctcctttctccctgggccgtcccctcccggcgccaccgggctcacaatctacctcgccggaggccaggggcagatcgtcggcggcggagtggtgggcccgctcgtggcggcgggccccgtattggtaatggcggctactttttccaatgctacgtatgaaagattgcctttagaggatgatgatcaggaacaacacggcggcggaggcggaggaggttcgccgcaggaaaaaaccgggggtcccggcgaggcgtcgtcgtcgatttcggtttataacaataatgttcctccgagtttaggtcttccgaatgggcaacatctgaaccatgaagcttattcttctccttggggtcattctcctcatgccagacctcctttctaattagc

SEQ ID NO: 384 - protein, 262 aa, Glycine max
  G3456 polypeptide Orthologous to G1073
MKKPDLGFSMNESTVTGNHIGEEDEDRENSDEPREGAIDVATTRRPRGRPPGSRNKPKPPIFVTRDSPNALRSHVMEIAVGADIADCVAQFARRRQRGVSILSGSGTVVNVNLRQPTAPGAVMALHGRFDILSLTGSFLPGPSPPGATGLTIYLAGGQGQIVGGGVVGPLVAAGPVLVMAATFSNATYERLPLEDDDQEQHGGGGGGGSPQEKTGGPGEASSSISVYNNNVPPSLGLPNGQHLNHEAYSSPWGHSPHARPPF

SEQ ID NO: 385 - DNA, 1153 bp, Glycine max
  G3458 Functionally related and homologous to G1073
tcgcccacgcgtccgtacggctgcgagaagacgacagaaggggccactttatttgtctctctctttcccttccaacctcatcccattccgttttctctgcagtactcaattgatccctttgtttttctattcgttctgagagctttgtgtgtatggccggcatagacttgggttcagcatcacattttgttcatcatcgccttgaacgccctgaccttgaagacgatgagaaccaacaagaccaagacaacaaccttaacaatcacgaagggcttgacctagttacaccaaattcaggtcctggtgatgttgttggtcgcaggccaagaggaagacctccaggttcaaagaacaagccaaaaccaccagttatcatcacaagagagagtgcaaacacccttagggctcacatccttgaagttagtagtggttgtgacgtctttgaatcggtcgctacctatgcaaggaagcgacaaagagggatctgtgtcctcagtgggagtggcaccgtgaccaacgtgacattgaggcagccggccgcggctggtgccgtcgtcacgctgcacggaaggtttgagatcctctctttgtcaggatcattcctcccacctccagctccaccaggtgctacaagtttgactgtgttccttggtggaggacagggtcaagtggtgggaggaaatgttgttggtcctttggtggcttctgggcctgttattgttattgcttcatcttttactaatgtagcatatgagaggttgcctttggatgaagatgaatctatgcagatgcaacaagggcaatcatcagctggtgatggtagcggtgaccatggtggtggagttagtaataactcttttccggatccgtcttccgggcttccattcttcaatttgccactaaacatgcctcagttacctgttgatggttgggctggcaactctggtggaaggcaatcttactgatccagagtctttgggggcacaaaggtgagaagttgaattgatctcatatatattggtcttctctaatctttcctctgaatattgcttgtgaagaagtactgatttttctattgaagaaatcgtttgtttggctaggtttgttgtaaggacgatcagtttctaggaacaactgtaaaacgttttctctt

SEQ ID NO: 386 - protein, 270 aa, Glycine max
  G3458 polypeptide  Functionally related and homologous to G1073
MAGIDLGSASHFVHHRLERPDLEDDENQQDQDNNLNNHEGLDLVTPNSGPGDVVGRRPRGRPPGSKNKPKPPVIITRESANTLRAHILEVSSGCDVFESVATYARKRQRGICVLSGSGTVTNVTLRQPAAAGAVVTLHGRFEILSLSGSFLPPPAPPGATSLTVFLGGGQGQVVGGNVVGPLVASGPVIVIASSFTNVAYERLPLDEDESMQMQQGQSSAGDGSGDHGGGVSNNSFPDPSSGLPFFNLPLNMPQLPVDGWAGNSGGRQSY

SEQ ID NO: 387 - DNA, 1596 bp, Glycine max
  G3459 Functionally related and homologous to G1073
ctgtcgcgtgggaaacaaatggctgcattgtgagttctttgtccccttcaacctcatttcaattctctctctcccccattcttacttcacccgcgccccctcccccgcccgctcccgtcccttttctttctctgcactccatctttctttccaaaacccacccttttctattcctcttcctcttcctccttttcccttctttttatttccttacactcacaacatttcccttaaaataaacataaacaaaccagcactgttcttgacccccaaaaaaaaaaaatctctactatttattaactatattaattcctccataatataatcatttgttttccttgttttctgttttctcttataatatataaccttcttttatctattttttctgttttgcaccttgtgattgtgagttatatctatttatatttatatatcattctctctcttttttttggatgtgtctatggctggtttggatttaggaagcgcctcacgctttgttcaaaaccttcacagaccagacttgcacttgcaacaaaatttccagcagcaccaggaccagcagcaccagcgtgatttggaggagcagaaaactcctccgaatcacagaatgggggcgccgttcgacgatgatagcgatgatagaagcccgggcctggagctcacttcaggtcctggcgacatcgtcggacggcgcccgcgtggcaggcctcctgggtcgaagaacaagcctaagccgcccgtcataatcacccgggagagcgccaacacgctgagggcgcacatcctcgaggtcggaagcggctccgacgtcttcgactgtgtcaccgcgtatgcccggcggcgccagcgtgggatctgcgtcctcagtggcagcggcaccgtcaccaatgtcagtctccggcagcctgcagctgccggtgccgtcgtcacgctgcacggcaggttcgagattctctccctctctggctcgttcctcccgccgccggctccgccgggagccaccagcctcacaatctacctggccggcgggcaggggcaggttgtcggaggaaacgtcatcggagaattaaccgcagcagggccagtaatcgtcatcgcagcgtcgttcaccaacgtggcttacgagaggttacccttagaagaagatgaacaacagcagcaacaacagcagcttcagattcagccacctgcaacgacgtcgtctcaaggaaacaacaacaacaataaccctttccccgacccttcttcaggacttcccttcttcaatttaccactcaatatgcagaatgttcagttaccagttgagggttgggctgtaaaccctgcttcacgtccacaacctttttgagagttcatgaagatgttgacggaggatttatatcacaaaaggctttatattattttaaggtcagcaaattaatattcatggactacaacatatatataaactatatgttttttcttcttcttcatgttattttgtttttttcttatgttgttaatggatataatatgacatgataattattatgtagtctgattttcatctccttggaattttatatacttatttcccctgttaaaaaaaaa

SEQ ID NO: 388 - protein, 295 aa, Glycine max
  G3459 polypeptide  Functionally related and homologous to G1073
MAGLDLGSASRFVQNLHRPDLHLQQNFQQHQDQQHQRDLEEQKTPPNHRMGAPFDDDSDDRSPGLELTSGPGDIVGRRPRGRPPGSKNKPKPPVIITRESANTLRAHILEVGSGSDVFDCVTAYARRRQRGICVLSGSGTVTNVSLRQPAAAGAVVTLHGRFEILSLSGSFLPPPAPPGATSLTIYLAGGQGQVVGGNVIGELTAAGPVIVIAASFTNVAYERLPLEEDEQQQQQQQLQIQPPATTSSQGNNNNNNPFPDPSSGLPFFNLPLNMQNVQLPVEGWAVNPASRPQPF

SEQ ID NO: 389 - DNA, 1443 bp, Glycine max
  G3460 PFunctionally related and homologous to G1073
tttccaaaacccacccttttctattcctcttcctgcttttcccttctttttatttccacacactcacaccacttcccttaaaataaacataaacaaaccaatactgttcttgacccaaaaaaaaaattatctactatttattaactatatttctccatattataatcatttgtattccttgttttctatgcttctcttataatatataaccttcgttttatttattttttttgttttgcaccttgtggattgtgagctatatctatttatatatatcattctctttctttttttttggatgtttctatggctggtttggatttaggaagcgcgtcacgctttgttcagaatcttcacttaccggacttgcacttgcaacaaaattaccagcaaccccggcacaagcgcgattcggaggagcaagagactcctccgaacccgggaacagcgctggcgccgttcgacaacgatgatgacaaaagccagggcttggagctggcttcaggccctggggacatcgttggacggcgcccacgcggcagaccttccgggtccaagaacaagccgaagccaccggtgataatcacccgggagagcgccaacacgctgagggcgcacattctcgaggtaggaagcggctccgacgtcttcgactgtgtcaccgcttatgcgcggcggcgccagcgcgggatctgcgtcctcagcggcagtggcaccgtcaccaatgtcagtctccggcagcctgcggctgccggagccgtcgtcaggctgcacggaaggttcgagattctctctctctccggctcgttcctcccgccgccggctccgccgggagccaccagtctcacaatctacctcgccggcgggcagggccaggtcgtcggaggaaacgtcgtgggagaattaaccgcggcagggccagtaatcgtcatcgcagcatcgttcaccaacgtggcttacgagaggctccccttagaagaagatgaacagcagcatcaacagcttcagattcagtcacccgcagcgacgtcatctcaaggaaacaacaacaataaccctttccctgacccttcttcaggacttcccttcttcaacttaccactcaatatgcagaatgttcagttaccacctttttgagggttcatgaatctgataatatgagactgatgaagatcatgttgatggaggatttatcaccaaagggtttatattattataaggtcagcaaatattcatggactagaacatatatataaactatatgttcttcttcttcttgttagtatgttttttttttcttctgttgttaatgggtatcgttatgataggacatgattattattattatgtagcgagtttcagtctgactctcatgtctttgggattttatttacttatttcccttgtccattattagaatatggaaccctgtattatttaatt

SEQ ID NO: 390 - protein, 276 aa, Glycine max
  G3460 polypeptide  Functionally related and homologous to G1073
MAGLDLGSASRFVQNLHLPDLHLQQNYQQPRHKRDSEEQETPPNPGTALAPFDNDDDKSQGLELASGPGDIVGRRPRGRPSGSKNKPKPPVIITRESANTLRAHILEVGSGSDVFDCVTAYARRRQRGICVLSGSGTVTNVSLRQPAAAGAVVRLHGRFEILSLSGSFLPPPAPPGATSLTIYLAGGQGQVVGGNVVGELTAAGPVIVIAASFTNVAYERLPLEEDEQQHQQLQIQSPAATSSQGNNNNNPFPDPSSGLPFFNLPLNMQNVQLPPF

SEQ ID NO: 391 - DNA, 1611 bp, Glycine max
  G3462 Predicted polypeptide sequence is orthologous to G1073
ccacgcgtccgcactctaaggtacttccccactgttcccattttatgcccgtactagtctgacccttttagtggcatagattgaggtacaattacaaaagcatattacccgtatcgtatcctttctgctacaaccaccccgaaacacactgcgttttttttgtgtcaaacttcaaccggggctttcttacttctcttctcttcaactttttagtgttttttttttttttttctcgtgtcgggtccttgagcttctatttgtttatttatttccggcagcgagttgagttaattttcgtgtcatagtctcaattaggtggatgtgacttgtgtggttagggtttacatgcaaaaacgcatgtgcttcgggtctaattcatcctgaaacaaggttttgggacagagatctgaatatttcaagctatctattttgtttctctatctagaaggttttgagaaatcaaagatggcgaatagatggtgggctgggaatgtgggaatgataagagagcaagagttgatggaaaacagcaacaacaacaacaacaacaacaacgctactactactacaccgacgacgaggagcaacagcaacactaacgcgaacaccaacaccaacacgaccgaggaagaggtgagcagggataacggagaggaccagaaccaaaacctcggcagccacgaagggtcggagcccggaagcagcggtcggaggccacgtggcaggccagcggggtccaagaacaagcccaagccgcccatagtcataatttttttaagccccaacgcgctccgaagccacgtcctggaaatcgcctccggccgcgatgtcgccgagagcatcgccgccttcgccaaccgccgccaccgtggcgtgtcggtcctcagcgggagtggcattgtagccaacgtcactctccgccagcccgccgcccccgccggcgtcataaccctccacgggaggttcgagatactctccctctcgggtgcctttttgccgtccccctcgccgtccggcgccaccggactgaccgtctacctagccggcgggcaggggcaggttgtcggcggcaacgtggcgggctctctcgtcgcctccggaccggtgatggtgatcgccgccactttcgctaatgccacttatgagaggttgcctctggaggatgatcaaggtgaggaggaaatgcaagtgcagcagcagcagcagcagcagcaacagcagcagcagcagcagcagcaacaacaatctcaaggtttgggggaacaggtttcaatgcctatgtataatttgcctcctaatttgctacacaatggtcagaacatgcctcatgatgtgttctggggagctccacctcgccctcctccttccttctgatcacccttgccaatatgatcatgtctttaatctctcactgacttgcgaattaagtactatgttaattaatttctcacggtttttcttgcaagcatagctagctagctagcaaggttagttattaggatggttttgttaatttgtgcttcttagagactcgagtcaagtagatgatgttcttatctttaatatactttgtagtactactggtttgtttattgttttttttaaaaaaaa

SEQ ID NO: 392 - protein, 302 aa, Glycine max
  G3462 polypeptide  Orthologous to G1073
MANRWWAGNVGMIREQELMENSNNNNNNNNATTTTPTTRSNSNTNANTNTNTTEEEVSRDNGEDQNQNLGSHEGSEPGSSGRRPRGRPAGSKNKPKPPIVIIFLSPNALRSHVLEIASGRDVAESIAAFANRRHRGVSVLSGSGIVANVTLRQPAAPAGVITLHGRFEILSLSGAFLPSPSPSGATGLTVYLAGGQGQVVGGNVAGSLVASGPVMVIAATFANATYERLPLEDDQGEEEMQVQQQQQQQQQQQQQQQQQQSQGLGEQVSMPMYNLPPNLLHNGQNMPHDVFWGAPPRPPPSF

SEQ ID NO: 393 - DNA, 555 bp, Glycine max
  G3470 Predicted polypeptide sequence is orthologous to G481 and G482
tcaccgggtttgtgagatgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagaggcggagggtgacactaaaggatctgctagaagtggtgatggatctgctagaccagatcaagttggccttgcaggtcaaaatgctcagcttgttcatcagggttcgctgaactatattggtttgcaggtgcaaccacaacatctggttatgccttcaatgcaaggccatgaatagtttagatgcttcta

SEQ ID NO: 394 - protein, 174 aa, Glycine max
  G3470 polypeptide  Orthologous to G481 and G482
MSDAPASPSHESGGEQSPRGSLSGAAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSARPDQVGLAGQNAQLVHQGSLNYIGLQVQPQHLVMPSMQGHE

SEQ ID NO: 395 - DNA, 556 bp, Glycine max
  G3471 Predicted polypeptide sequence is orthologous to G481 and G482
gtagggtttgtgagatgtcggatgcgccaccgagcccgactcatgagagtgggggcgagcagagcccgcgcggttcgtcgtccggcgcgagggagcaggaccggtacctcccgattgccaacatcagccgcattatgaagaaggctctgcctcccaacggcaagattgcaaaggatgccaaagacaccatgcaggaatgcgtttctgagttcatcagcttcattaccagcgaggcgagtgagaaatgccagaaggagaagagaaagacaatcaatggagacgatttgctatgggccatggccactttaggatttgaagactacatagagccgcttaaggtgtacctggctaggtacagagaggcggagggtgacactaaaggatctgctagaagtggtgatggatctgctacaccagatcaagttggccttgcaggtcaaaattctcagcttgttcatcagggttcgctgaactatattggtttgcaggtgcaaccacaacatctggttatgccttcaatgcaaagccatgaatagtttagatgcttctacgcatc

SEQ ID NO: 396 - protein, 173 aa, Glycine max
  G3471 polypeptide  Orthologous to G481 and G482
MSDAPPSPTHESGGEQSPRGSSSGAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSATPDQVGLAGQNSQLVHQGSLNYIGLQVQPQHLVMPSMQSHE

SEQ ID NO: 397 - DNA, 547 bp, Glycine max
  G3472  Predicted polypeptide sequence is orthologous to G481 and G482
taaggctagctagctagccatggctgagtcggacaacgagtccggaggtcacacggggaacgcaagcggaagcaacgaattctccggttgcagggagcaagacaggttccttccgatagcgaacgtgagcaggatcatgaagaaggcgttgccggcgaacgcgaagatctcgaaggaggcgaaggagacggtgcaggagtgcgtgtcggagttcatcagcttcataacaggagaagcgtccgataagtgccagaaggagaagaggaagacgatcaacggcgatgatctgctgtgggccatgaccacgctgggattcgaggagtacgtggagcctctcaaggtttatctgcataagtatagggagctggaaggggagaaaactgctatgatgggaaggccacatgagagggatgagggttatggtcatgcaactcctatgatgatcatgatggggcatcaacagcagcagcatcagggacacgtgtatggatctggaactactactggatcagcatcttctgcaagaactagataacaggtttatgca

SEQ ID NO: 398 - protein, 171 aa, Glycine max
  G3472 polypeptide  Orthologous to G481 and G482
MAESDNESGGHTGNASGSNEFSGCREQDRFLPIANVSRIMKKALPANAKISKEAKETVQECVSEFISFITGEASDKCQKEKRKTINGDDLLWAMTTLGFEEYVEPLKVYLHKYRELEGEKTAMMGRPHERDEGYGHATPMMIMMGHQQQQHQGHVYGSGTTTGSASSARTR

SEQ ID NO: 399 - DNA, 1818 bp, Glycine max
  G3473 Predicted polypeptide sequence is orthologous to G481 and G482
tttttaaataataaaatgtttctttggaaatttcttaaaaagtatgaacataaatttaaattattattttatattaaatgcacttatgttaatttatttgtcttgcatacacatttaatgttatccttctttatatctatattaaactatatatataaagaaaagattttgaaatttgaataagataagagtgtccaggtcagaggcgagcacgtgccagataccaaagcaacggtccagatcatggagcactcaccaaatccaagggctccaattcgtccgtggacactcacacttatcgactaacaacggtccacaaatcgccacgtgtcctcaagataaagcgttattaacccttctgatccaacggatcctgctcattatctcccaaacaaacccctccgttccgtttcacctttccccttcccgccggagccgccgtcaccggtcgctggccaccgtatccgaccctcccaatacaccctttccgagtcccacacaaaattgcacgattctgtgatttcaattttcaggtctcgaggatttcgtttcagaagcgcttccatttgacgcagaaccaccgactcaaaccgattcgcgccgagttcgtgactcgaattttcaacttctcattcatattccaaatcgaatttgaaactccgaagaaaaattcaccgaacactgaatctcagtttccaaggagcttcttctacgaagagcgcttcaattccacgcagaaccaccaagtcaagccggttcgtgactcggattctcaattcctcgttcattcccgaacgaattttaaattccgaagaaaaccgcaccgaacactgaatttcagattctgaacaagtttcttccgcgaaacagcacagcacttcaatttcacgtggaacagagacaaagggattcgtggttcgaattctcaatcgattttcaaattccgaacagcgaacagtacttcaatttcacgtcgaactagtcaaagcgattcaaatcgatttcgcgaactcgtccgatattttccctgcactgacttagtgattcgtttcatctttctcagcgcgtcttcgatttttccgttagtcgatggcggactccgacaacgactccggcggcgcgcacaacggcggcaaggggagcgagatgtcgccgcgggagcaggaccggtttctcccgatcgcgaacgtgagccgcatcatgaagaaggcgctgccggcgaacgcgaagatctcgaaggacgcgaaggagacggtgcaggagtgcgtgtcggagttcatcagcttccattcaccggggggcctcgccggtgagtgccagaaggagaagaggaagacgatcaacggcgatgatctgctgtgggccatgaccacgctgggattcgaggagtacgtggagcctctcaaggtttatctgcataagtatagggagctggaaggggagaaaactgctatgatgggaaggccacatgagagggatgagggttatggtcatgcaactcctatgatgatcatgatggggcatcagcagcagcagcatcagggacacgtgtatggatctggaactactactggatcagcatcttctgcaagaactagataacaggtttatgcatgtgttatctcatctgtttaagcttattaagggtggtctttttggatggtgattttgtttgattttagaaacaccccagctccagcttgtaattgttgcttgaaacttcgttgttgagagaatatagccattattgtggatggtgatgtgacatgcacagaatttttgtattcttctttcttccaatggatttatctcgggccc

SEQ ID NO: 400 - protein, 170 aa, Glycine max
  G3473 polypeptide  Orthologous to G481 and G482
MADSDNDSGGAHNGGKGSEMSPREQDRFLPIANVSRIMKKALPANAKISKDAKETVQECVSEFISFHSPGGLAGECQKEKRKTINGDDLLWAMTTLGFEEYVEPLKVYLHKYRELEGEKTAMMGRPHERDEGYGHATPMMIMMGHQQQQHQGHVYGSGTTTGSASSARTR

SEQ ID NO: 401 - DNA, 553 bp, Glycine max
  G3474 Predicted polypeptide sequence is orthologous to G481 and G482
gatatccatggctgagtccgacaacgagtcaggaggtcacacggggaacgcgagcgggagcaacgagttgtccggttgcagggagcaagacaggttcctcccaatagcaaacgtgagcaggatcatgaagaaggcgttgccggcgaacgcgaagatatcgaaggaggcgaaggagacggtgcaggagtgcgtgtcggagttcatcagcttcataacaggagaggcttccgataagtgccagaaggagaagaggaagacgatcaacggcgacgatcttctctgggccatgactaccctgggcttcgaggactacgtggatcctctcaagatttacctgcacaagtatagggagatggagggggagaaaaccgctatgatgggaaggccacatgagagggatgagggttatggccatggccatggtcatgcaactcctatgatgacgatgatgatggggcatcagccccagcaccagcaccagcaccagcaccagggacacgtgtatggatctggatcagcatcttctgcaagaactagatagcatgtgtcatct

SEQ ID NO: 402 - protein, 177 aa, Glycine max
  G3474 polypeptide  Orthologous to G481 and G482
MAESDNESGGHTGNASGSNELSGCREQDRFLPIANVSRIMKKALPANAKISKEAKETVQECVSEFISFITGEASDKCQKEKRKTINGDDLLWAMTTLGFEDYVDPLKIYLHKYREMEGEKTAMMGRPHERDEGYGHGHGHATPMMTMMMGHQPQHQHQHQHQGHVYGSGSASSARTR

SEQ ID NO: 403 - DNA, 600 bp, Glycine max
  G3475 Predicted polypeptide sequence is orthologous to G481 and G482
tcgattatccgtttgtcgatggcggactcggacaacgactccggcggcgcgcacaacgccgggaaggggagcgagatgtcgccgcgggagcaggaccggttcctgccgatcgcgaacgtgagccgcatcatgaagaaggcgctgccggcgaacgcgaagatctcgaaggacgcgaaggagacggtgcaggagtgcgtgtcggagttcatcagcttcatcaccggcgaggcctccgacaagtgccagcgggagaagcgcaagacgatcaacggcgacgacctgctctgggcgatgaccactctcggcttcgaggactacgtcgagcctctcaagggctacctccagcgcttccgagaaatggaaggagagaagacagtggcggcgcgtgacaaggacgcgcctcctcctaccaatgctaccaacagtgcctacgagagtcctagttatgctgctgctcctggtggaatcatgatgcatcagggacacgtgtacggttctgccggcttccatcaagtggctggtggtgctataaagggtgggcctgtttatcccgggcctggatccaatgccggtaggcccaggtagatgggcctatgttat

SEQ ID NO: 404 - protein, 188 aa, Glycine max
  G3475 polypeptide  Orthologous to G481 and G482
MADSDNDSGGAHNAGKGSEMSPREQDRFLPIANVSRIMKKALPANAKISKDAKETVQECVSEFISFITGEASDKCQREKRKTINGDDLLWAMTTLGFEDYVEPLKGYLQRFREMEGEKTVAARDKDAPPPTNATNSAYESPSYAAAPGGIMMHQGHVYGSAGFHQVAGGAIKGGPVYPGPGSNAGRPR

SEQ ID NO: 405 - DNA, 528 bp, Glycine max
  G3476 Predicted polypeptide sequence is orthologous to G481 and G482
ggattgattgtgaagatggctgagtcggacaacgactcgggaggggcgcagaacgcgggaaacagtggaaacttgagcgagttgtcgcctcgggaacaggaccggtttctccccatagcgaacgtgagcaggatcatgaagaaggccttgccggcgaacgcgaagatctcgaaggacgcgaaggagacggtgcaggaatgcgtgtcggagttcatcagcttcataacgggtgaggcgtcggacaagtgccagagggagaagcgcaagaccatcaacggcgacgatcttctctgggccatgacaaccctgggattcgaagagtacgtggagcctctgaagatttacctccagcgcttccgcgagatggagggagagaagaccgtggccgcccgcgactcttctaaggactcggcctccgcctcctcctatcatcagggacacgtgtacggctcccctgcctaccatcatcaagtgcctgggcccacttatcctgcccctggtagacccagatgacgtgctcctctattc

SEQ ID NO: 406 - protein, 165 aa, Glycine max
  G3476 polypeptide  Orthologous to G481 and G482
MAESDNDSGGAQNAGNSGNLSELSPREQDRFLPIANVSRIMKKALPANAKISKDAKETVQECVSEFISFITGEASDKCQREKRKTINGDDLLWAMTTLGFEEYVEPLKIYLQRFREMEGEKTVAARDSSKDSASASSYHQGHVYGSPAYHHQVPGPTYPAPGRPR

SEQ ID NO: 407 - DNA, 568 bp, Glycine max
  G3477 Predicted polypeptide sequence is orthologous to G481 and G482
tcgacttgtagggtttgtgagatgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagaggcggagggtgacactaaaggatctgctagaagtggtgatggatctgctagaccagatcaagttggccttgcaggtcaaaatgctcagcttgttcatcagggttcgctgaactatattggtttgcaggtgcaaccacaacatctggttatgccttcaatgcaaggccatgaatagtttagatgcttctacgcatcgc

SEQ ID NO: 408 - protein, 174 aa, Glycine max; identical to SEQ ID NO: 394
  G3477 polypeptide  Orthologous to G481 and G482

SEQ ID NO: 409 - DNA, 602 bp, Glycine max
  G3478 Predicted polypeptide sequence is orthologous to G481 and G482
ttccgttagtcgatggcggactccgacaacgactccggcggcgcgcacaacggcggcaaggggagcgagatgtcgccgcgggagcaggaccggtttctcccgatcgcgaacgtgagccgcatcatgaagaaggcgctgccggcgaacgcgaagatctcgaaggacgcgaaggagacggtgcaggagtgcgtgtcagagttcatcagcttcatcaccggcgaggcctccgacaagtgccagcgcgagaagcgcaagacgatcaacggcgacgacctgctctgggcgatgaccactctgggcttcgaggactacgtggagcctctcaaaggctacctccagcgcttccgagaaatggaaggagagaagaccgtggcggcgcgtgacaaggacgcgcctcctcttacgaatgctaccaacagtgcctacgagagtgctaattatgctgctgctgctgctgttcctggtggaatcatgatgcatcagggacacgtgtacggttctgccggcttccatcaagtggctggcggggctataaagggtgggcctgcttatcctgggcctggatccaatgccggtaggcccagataaagagcctattatta

SEQ ID NO: 410 - protein, 191 aa, Glycine max
  G3478 polypeptide  Orthologous to G481 and G482
MADSDNDSGGAHNGGKGSEMSPREQDRFLPIANVSRIMKKALPANAKISKDAKETVQECVSEFISFITGEASDKCQREKRKTINGDDLLWAMTTLGFEDYVEPLKGYLQRFREMEGEKTVAARDKDAPPLTNATNSAYESANYAAAAAVPGGIMMHQGHVYGSAGFHQVAGGAIKGGPAYPGPGSNAGRPR

SEQ ID NO: 411 - DNA, 803 bp, Oryza sativa (japonica cultivar-group)
  G3556 Predicted polypeptide sequence is orthologous to G1073
tcgacgggatggggagcatcgacggccactcgctgcagcagcatcaggggtactcccacggcggcggcgcgggagggagcaacgaggaggaggaggcgtcgccgccgcccggcggtggctcggctacggggtcggcgggccgccggccgagggggaggccgccgggctccaagaacaagccgaagccgcccgtcgtggtgacgcgggagagccccaacgcgatgcgttcccacgtgctggagatcgccagcggcgccgacatcgtcgaggccatcgcgggcttctcccgccgcaggcagcgcggcgtctccgtgctcagcgggagcggcgccgtcaccaacgtcacgctccggcagcccgcggggactggggccgccgccgtcgcgctgcgggggaggttcgagatattgtccatgtctggcgccttcctcccggcgccggcgccgccaggggccacggggctcgccgtgtacctcgccggcgggcaggggcaggtggtgggtgggagcgtcatgggggagctgatcgcgtcgggccccgtcatggtgatcgcggccacgttcggcaacgccacgtacgagaggctgccgctggaccaggaaggcgaggagggcgccgtgctgtccgggtcggagggcgccgccgcgcagatggagcagcagagcagcggaggcgccgtcgtgcccccgccgatgtacgccgccgtccagcagacgccgccgcacgacatgttcgggcagtgggggcatgcagcggtggctcggccgccgccgacatcgttctagcactggcaccggttaatt

SEQ ID NO: 412 - protein, 258 aa, Oryza sativa (japonica cultivar-group)
  G3556 polypeptide  Orthologous to G1073
MGSIDGHSLQQHQGYSHGGGAGGSNEEEEASPPPGGGSATGSAGRRPRGRPPGSKNKPKPPVVVTRESPNAMRSHVLEIASGADIVEAIAGFSRRRQRGVSVLSGSGAVTNVTLRQPAGTGAAAVALRGRFEILSMSGAFLPAPAPPGATGLAVYLAGGQGQVVGGSVMGELIASGPVMVIAATFGNATYERLPLDQEGEEGAVLSGSEGAAAQMEQQSSGGAVVPPPMYAAVQQTPPHDMFGQWGHAAVARPPPTSF

SEQ ID NO: 413 - DNA, 435 bp, Oryza sativa (japonica cultivar-group)
  G3835 Predicted polypeptide sequence is orthologous to G481 and G482
atgacgaacgggcaggacaacctgctgccgatcgccaacgtgggccggatcatgaaggacgggctgccgccgcaggcgaagatatcgaagcgggccaaggagacgatccaggagtgcgcgacggagttcatcagcttcgtcaccggcgaggcgtcggagcggtgccggcgggagcggcggaagacggtgaacggcgacgacgtctgccacgccatgaggagcctcggcctcgaccactacgccgacgccatgcacaggtacctgcagaggtaccgcgagggcgaggagctcgccgcgtcgctcaacagcagcagcagcgccgccgccgccgccgccgccgccggcagcaggggcggtggcgccatacagatcgacgtgagagctgagctctccatcttcagatcaggcaacaaccaaggtcgtccaaacaattaa

SEQ ID NO: 414 - protein, 144 aa, Oryza sativa (japonica cultivar-group)
  G3835 polypeptide  Orthologous to G481 and G482
MTNGQDNLLPIANVGRIMKDGLPPQAKISKRAKETIQECATEFISFVTGEASERCRRERRKTVNGDDVCHAMRSLGLDHYADAMHRYLQRYREGEELAASLNSSSSAAAAAAAAGSRGGGAIQIDVRAELSIFRSGNNQGRPNN

SEQ ID NO: 415 - DNA, 534 bp, Oryza sativa (japonica cultivar-group)
  G3836 Predicted polypeptide sequence is orthologous to G481 and G482
atggccgaccaccatggcggccaccacgccgacgggcatcgccggcagcagcagctgcagggggaggcggcggatcaggcggcggcggagatcatcaaggagcaggacaggttgctgccaatcgcgaacgtggggcgaatcatgaagcagatcctcccccccaacgccaagatctccaaggaggccaaggagacgatgcaggagtgcgtctcggagttcatcagcttcgtcaccggcgaggcctccgacaagtgccacaaggagaagcgcaagacggtcaacggcgacgacgtctgctgggccttcggcgccctcggcttcgacgactacgtcgaccccatgcgcaggtacctcaacaagtaccgcgagctcgagggcgaccgcgccgccgccgccgccacctcccgctccggcgccggcgccgccgcgggccccgaccacccttcctcctcctcctccgccgccgccgccaccgccggtcatttcatgttcaacgccatggacaggtcgacggatagctccaggcagttctag

SEQ ID NO: 416 - protein, 177 aa, Oryza sativa (japonica cultivar-group)
  G3836 polypeptide  Orthologous to G481 and G482
MADHHGGHHADGHRRQQQLQGEAADQAAAEIIKEQDRLLPIANVGRIMKQILPPNAKISKEAKETMQECVSEFISFVTGEASDKCHKEKRKTVNGDDVCWAFGALGFDDYVDPMRRYLNKYRELEGDRAAAAATSRSGAGAAAGPDHPSSSSSAAAATAGHFMFNAMDRSTDSSRQF

SEQ ID NO: 417 - DNA, 795 bp, Glycine max
  G3837 Predicted polypeptide sequence is orthologous to G481 and G482
ctgtgtttgagaggactaaagtaaacagatgggtgacaacaacataggcaaagtcttagagagagaaggctttaagtacaacttcacggcagctgcaagtgacacctctgcacaagatgaggtgattaaagagcaagatcggttgcttccaatagcaaatgtggggcgcatcatgaagcaaatccttcctcctaacgccaagatctcaaaggaagctaaagaaaccatgcaagaatgtgtgtccgagttcattagctttgtcactggggaagcttctgacaagtgtcacaaggagaagcgcaagaccgtgaatggcgacgatatttgctgggcccttgctaccctagggtttgatgactactctgagccacttaaaaggtacttgcataagtatagggagttcgaaggggagagagcaaatcaaaataagggtaacaacaacacttatgaaaacaacattgcaaacatataaattaattatgtggaaggtgaactctttctccaattcccatgatcaatgtgattgatagttgttaatctgatcttctagttttctcctgaatttgagatactcaaggggcttgtatccttatgtgatatatatatgacgtgagtcatgtatgcaaactcacgtgttttagacctgatattttcatcaagggttgaaattaccctagatgaacacatggtagcttgagaatcatgtgagttacaactaatctttgtatttgtctatccaataataagcttggatcctttccagaaaaaaaaaaaaaaaaaaaaaaaaaaaaaaaa

SEQ ID NO: 418 - protein, 147 aa, Glycine max
  G3837 polypeptide  Orthologous to G481 and G482
MGDNNIGKVLEREGFKYNFTAAASDTSAQDEVIKEQDRLLPIANVGRIMKQILPPNAKISKEAKETMQECVSEFISFVTGEASDKCHKEKRKTVNGDDICWALATLGFDDYSEPLKRYLHKYREFEGERANQNKGNNNTYENNIANI

SEQ ID NO: 419 - DNA, 957 bp, Arabidopsis thaliana
  G24
cggacgcgtgggcaaatattaaaataaaaagtgtcggtgaattctcaatctttgtcttctttcgtcgtctctttaaaactcctccgtccctccttattatgtaaccgtctcgccgtcaaattttcaaaatctctccctccgttcataaacccagatcgaaatttatggttttgtaatttttttaccggcggttatggagacggaagcggcggtgacagcgacggttacggcggcgacgatggggattgggacgaggaagagagatctgaaaccgtataaaggaatacgaatgaggaaatgggggaaatgggtggcggagatacgggaaccgaataagagatcaaggatctggttaggttcttatgcgacgcctgaagcggcggcgagagcttacgacactgctgttttttacctccgtggtccttcagcgaggcttaattttccggagcttttggctggacttactgtttctaacggcggaggaagaggtggtgatttatcggcggcgtatattaggagaaaagcggcggaggttggtgctcaggttgatgcgcttggagcgacggtggttgtgaataccggcggcgagaatcgcggtgattacgagaagattgagaattgtcgtaagagcggtaacgggtcattggaacgggtcgatttgaataaattacccgacccggaaaattcggatggtgatgatgacgaatgtgtgaaaagaagatagaaaaaataaaaagtagttgtagaaggagagacgagaatgtttgtctttaagatgcgctgttgccgctaacatgcgctttcgattttagtgttaaacatgcgcctccattgtttttgggttttgttttcgtcgtcgataatcaaagattttaaaacacaattctcaaatttttcacttgttacaaactagatttgcatgatctttgtattaacgaataacgattaagtcctaaa

SEQ ID NO: 420 - protein, 176 aa, Arabidopsis thaliana
  G24
METEAAVTATVTAATMGIGTRKRDLKPYKGIRMRKWGKWVAEIREPNKRSRIWLGSYATPEAAARAYDTAVFYLRGPSARLNFPELLAGLTVSNGGGRGGDLSAAYIRRKAAEVGAQVDALGATVVVNTGGENRGDYEKIENCRKSGNGSLERVDLNKLPDPENSDGDDDECVKRR

SEQ ID NO: 421 - DNA, 985 bp, Arabidopsis thaliana
  G154
ctctacctatacatacacaaaccctttatcctcgaaagcttcctcctggttaggtttttatcaaacccttttagccaatcgggaaattaactaaagaagaagatatggtgaggggcaaaactcagatgaagagaatagagaatgcaacaagcagacaagtgactttctccaaaagaaggaatggtttgttgaagaaagcctttgagctctcagtgctttgtgatgctgaagtttctcttatcatcttctctcctaaaggcaaactttatgaattcgccagctccaatatgcaagataccatagatcgttatctgaggcatactaaggatcgagtcagcaccaaaccggtttctgaagaaaatatgcagcatttgaaatatgaagcagcaaacatgatgaagaaaattgaacaactcgaagcttctaaacgtaaactcttgggagaaggcataggaacatgctcaatcgaggagctgcaacagattgagcaacagcttgagaaaagtgtcaaatgtattcgagcaagaaagactcaagtgtttaaggaacaaattgagcagctcaagcaaaaggagaaagctctagctgcagaaaacgagaagctctctgaaaagtggggatctcatgaaagcgaagtttggtcaaataagaatcaagaaagtactggaagaggtgatgaagagagtagcccaagttctgaagtagagacgcaattgttcattgggttaccttgttcttcaagaaagtgatctccactcaacaaaaaaaacaaaaaaacaaactaagtaaaaacaggtttagcagtactgagagtgtataaggacaagtaacaaaactctaaagctgcttctctcttgttgtcttatttctctctcactctctctctctcagtcacttctttaatgattctgaactgcttgtgttatgtatctatgttcttacacttgcctctctagaatgtaattttgattatgttttgttttca

SEQ ID NO: 422 - protein, 214 aa, Arabidopsis thaliana
  G154
MVRGKTQMKRIENATSRQVTFSKRRNGLLKKAFELSVLCDAEVSLIIFSPKGKLYEFASSNMQDTIDRYLRHTKDRVSTKPVSEENMQHLKYEAANMMKKIEQLEASKRKLLGEGIGTCSIEELQQIEQQLEKSVKCIRARKTQVFKEQIEQLKQKEKALAAENEKLSEKWGSHESEVWSNKNQESTGRGDEESSPSSEVETQLFIGLPCSSRK

SEQ ID NO: 423 - DNA, 2940 bp, Arabidopsis thaliana
  G384
gttttttcttctgaagagtgatatatattctacctttctctggttaaagaaactccctgaatccaccggttatgtcttgaccggctttaagcctataaactgatgccctaagacacctttttaggtttctcaataattctccgcatctatcttttcttctccacaagtaagggaaccagaaaaccagggaagaatccgagcaagctagggtttcattgtgtgcacaaaatgggatatacaggcagaagaaaatcgagataaatcaactaaatgatttggataatcatcttgaagatttgaaggatttcgagactaagtccggcgcagaagtcaccatggagaatcctttagaagaagagcttcaagatcctaatcagcgtcccaacaaaaagaagcgttaccaccgtcacacacaacgccagattcaagagctagagtcgttcttcaaggaatgtcctcatccagacgataagcaaagaaaggagctgagtcgcgagctaagcttagaacctcttcaagtcaagttctggttccaaaacaaacgcactcaaatgaaggcacaacatgagaggcacgagaaccagatactgaagtcagaaaatgacaagctccgagcagagaacaataggtacaaggatgctctaagcaacgcaacatgcccaaactgtggtggtccggcagctataggagaaatgtccttcgacgaacagcatttaaggatcgaaaatgctcgtttacgcgaagagattgacagaatctctgccatagctgctaaatacgtagggaagcctttaatggctaattcctcttctttccctcagctctcttcttcacaccacattccctcgcgctcgcttgatcttgaagttgggaactttgggaacaataacaatagccacactggtttcgttggggaaatgtttggaagcagcgacattttgaggtcggtttcgataccttctgaggctgataagcctatgattgttgagttagctgttgcagcaatggaagagcttgtgagaatggctcaaactggtgatcccttatgggtttcaagcgataattctgttgagattctcaatgaagaagagtattttaggacgtttcctagaggaattggaccgaaacctatcggtttgagatcagaagcttcaagagagtctactgttgttatcatgaatcatatcaatctcattgagattctaatggatgtgaatcaatggtctagtgtgttctgcgggattgtatcaagagcattgactctagaagttctctcaactggcgtacgagggaactacaatggggcattgcaagtgatgacagcagagttccaagtcccatcgccgcttgtccctactcgtgagaactactttgtaaggtactgtaaacagcacagtgacggtatttgggcggttgtggatgtctctttggacagcctaagaccaagtccgatcactagaagcagaagaagaccctctggttgtctgattcaagaattgcagaatggttactccaaggtgacatgggtagagcatattgaggtggatgatagatcggttcacaacatgtataaaccgttggttaataccggtttagctttcggtgcaaaacgttgggtggctacacttgaccgccaatgtgagcggctcgccagttccatggccagcaacattccggcttgtgatctttccgtgataacgagtcctgaggggagaaagagcatgctgaaactagcggagagaatggtgatgagcttctgtaccggagtcggcgcgtcaaccgccgatgcctggactacattgtcgaccacaggatccgacgacgttcgggtcatgacccgaaagagcatggatgatccgggaagacctccaggcatcgttctcagcgccgctacttctttctggatccctgtagctccaaaacgagtgttcgattttctcagagatgaaaactcaagaagcgagtgggatatactttccaatggaggcttggttcaagaaatggctcatatcgcaaatggtcgtgatcctgggaatagtgtctccttgcttcgagtcaatagtgggaactcagggcagagcaacatgttgatcttacaagaaagttgtacggacgcatcagggtcctatgtgatatacgcaccagttgatataatagctatgaacgttgtcctgagtggtggtgatccggattatgtcgctttgttaccatccggattcgctattttgccggatggctctgctagaggaggaggaggtagtgctaatgccagtgctggagccggagttgaaggaggaggagaggggaataatcttgaagtggttactactactgggagttgtggcggttcactactcacagttgcgtttcagatacttgttgactctgttcctaccgctaaactctctctcggttcagttgctacagtcaatagtctgatcaaatgcactgtcgagcggattaaagccgctctggcctgcgacggagcctaatcgatgttttcggaaggtaagagtgaaaggggaggtttagggagtttatgataatgtttgtgttcttttggtttttaaagtcttttgagattctccaaaggaagtcaagaacgctcctttttgcgtttaatctcatttccgcgtttgttagcggacgggccaaagaaagaggcttgagaaagaaaaggtaaagaggttcgggtattgacttctgctggaaccaaaaaaaaaggaatcgggtttgttgtgtttcggcggtttagcattttgcgttttctttgttattatttatcattgactagtgaacagtttagcgttctgcttttcgcgtctactgtgaaactccttgttattaagccactctagtggtactgtcattatatattatgaatctatgaaactgtgtttattagtttgtttctttaatccaaacttgagattctcttct

SEQ ID NO: 424 - protein, 718 aa, Arabidopsis thaliana
  G384
MENPLEEELQDPNQRPNKKKRYHRHTQRQIQELESFFKECPHPDDKQRKELSRELSLEPLQVKFWFQNKRTQMKAQHERHENQILKSENDKLRAENNRYKDALSNATCPNCGGPAAIGEMSFDEQHLRIENARLREEIDRISAIAAKYVGKPLMANSSSFPQLSSSHHIPSRSLDLEVGNFGNNNNSHTGFVGEMFGSSDILRSVSIPSEADKPMIVELAVAAMEELVRMAQTGDPLWVSSDNSVEILNEEEYFRTFPRGIGPKPIGLRSEASRESTVVIMNHINLIEILMDVNQWSSVFCGIVSRALTLEVLSTGVRGNYNGALQVMTAEFQVPSPLVPTRENYFVRYCKQHSDGIWAVVDVSLDSLRPSPITRSRRRPSGCLIQELQNGYSKVTWVEHIEVDDRSVHNMYKPLVNTGLAFGAKRWVATLDRQCERLASSMASNIPACDLSVITSPEGRKSMLKLAERMVMSFCTGVGASTADAWTTLSTTGSDDVRVMTRKSMDDPGRPPGIVLSAATSFWIPVAPKRVFDFLRDENSRSEWDILSNGGLVQEMAHIANGRDPGNSVSLLRVNSGNSGQSNMLILQESCTDASGSYVIYAPVDIIAMNVVLSGGDPDYVALLPSGFAILPDGSARGGGGSANASAGAGVEGGGEGNNLEVVTTTGSCGGSLLTVAFQILVDSVPTAKLSLGSVATVNSLIKCTVERIKAALACDGA

SEQ ID NO: 425 - DNA, 890 bp, Arabidopsis thaliana
  G545
gcaaccttcaaactaaaactcgagagacaagaaatcctcagaatctttaacttaatggcgctcgaggctcttacatcaccaagattagcttctccgattcctcctttgttcgaagattcttcagtcttccatggagtcgagcactggacaaagggtaagcgatctaagagatcaagatccgatttccaccaccaaaacctcactgaggaagagtatctagctttttgcctcatgcttctcgctcgcgacaaccgtcagcctcctcctcctccggcggtggagaagttgagctacaagtgtagcgtctgcgacaagacgttctcttcttaccaagctctcggtggtcacaaggcaagccaccgtaagaacttatcacagactctctccggcggaggagatgatcattcaacctcgtcggcgacaaccacatccgccgtgactactggaagtgggaaatcacacgtttgcaccatctgtaacaagtcttttccttccggtcaagctctcggcggacacaagcggtgccactacgaaggaaacaacaacatcaacactagtagcgtgtccaactccgaaggtgcggggtccactagccacgttagcagtagccaccgtgggtttgacctcaacatccctccgatccctgaattctcgatggtcaacggagacgacgaagtcatgagccctatgccggcgaagaagcctcggtttgactttccggtcaaacttcaactttaaggaaatttacttagacgataagatttcgtttgtatactgttgagagttgtgtaggaatttgttgactgtacataccaaattggactttgactgattccaattcttcttgttctttcattttaaaaattattaaaccgattctttaccacaaa

SEQ ID NO: 426 - protein, 227 aa, Arabidopsis thaliana
  G545
MALEALTSPRLASPIPPLFEDSSVFHGVEHWTKGKRSKRSRSDFHHQNLTEEEYLAFCLMLLARDNRQPPPPPAVEKLSYKCSVCDKTFSSYQALGGHKASHRKNLSQTLSGGGDDHSTSSATTTSAVTTGSGKSHVCTICNKSFPSGQALGGHKRCHYEGNNNINTSSVSNSEGAGSTSHVSSSHRGFDLNIPPIPEFSMVNGDDEVMSPMPAKKPRFDFPVKLQL

SEQ ID NO: 427 - DNA, 2001 bp, Arabidopsis thaliana
  G760
tgcttaattccaatgccatcgtgatcgattcatctctctctctctcttccaattttcccaattcttttttaaaaccctaatttttcagatatctgattatctcttgtatttcttctactcgatttgctcccataaaaacccttactttcttcaagttctggttttcaccgattgatgggtcgtggctcagtgacgtcgcttgctcctgggttccgttttcacccgacggatgaggaacttgttcgctactaccttaagcgtaaggtctgcaacaaaccctttaagttcgatgctatttccgtcaccgacatatacaagtctgagccttgggatctaccagataagtcgaagctgaaaagtagagacttggaatggtacttctttagtatgctggataagaagtacagtaatggttccaagacgaatcgtgctacggagaaagggtattggaagacgactgggaaagatcgggagattcgtaatggttcaagagtcgttgggatgaagaagacacttgtttatcacaagggtcgagctcctcgtggtgaaaggaccaattgggttatgcatgagtatcggctttctgatgaggacttgaagaaagctggtgtgccacaagaagcatatgtgttatgtaggatattccagaaaagtggtacgggtcctaagaatggggagcagtatggtgctccttatcttgaggaggagtgggaagaagatggaatgacttatgtacctgctcaagatgctttcagtgaaggattggctttgaatgatgatgtttatgtcgatattgatgacattgacgagaagcccgaaaatctggtggtctatgatgccgttcctattctacctaactattgtcatggggaatcaagtaacaatgttgaatcaggcaattactcagactctggaaattacattcaaccaggaaacaatgttgtcgactctggtgggtactttgaacaaccaattgaaacttttgaggaagatcggaagcctattatacgggagggtagcattcagccttgttctctgtttccagaggaacaaattggctgtggtgtgcaagacgaaaatgtggtgaatctggaatcttccaacaataatgtgtttgtagctgatacatgctacagtgacattcctattgatcataactatttacccgatgagccattcatggatcctaataacaatcttccactcaacgatggtctgtacctggaaacgaatgatctcagctgtgctcaacaagatgattttaacttcgaagattatctcagcttctttgatgatgagggtttgacttttgacgattctctattaatgggacctgaagattttcttcccaaccaagaagcccttgaccagaaacctgcccctaaagaattggagaaggaggtcgcaggaggcaaagaggcagtggaggaaaaggaaagtggcgaaggatcttcttcaaaacaagatacagatttcaaggactttgattcagctccgaagtacccatttctcaaaaagacgagccacatgcttggagccattcctactccatcttcatttgcttcacagttccaaacaaaggacgcaatgcgtctacacgcagcacaatcttctggttcagttcacgtgactgcaggtatgatgagaatatcaaacatgactctagcagcggacagcggtatgggctggtcatatgacaagaacggtaacctcaacgtagtcctttcattcggggtagtccaacaggatgatgcgatgactgcctcgggaagcaagacaggaattacggcgacaagagctatgttagtcttcatgtgtttatgggttctcctactctctgttagcttcaaaatagtaaccatggtgtctgctcggtaataggatcaaagttgaatcgtctcaaagactttttttggtgtttgtacctctccaatcatatagcctttaactttggcagtgctttgctgctcaatatttaaattttaaaaaaaaaaaaaaaaa

SEQ ID NO: 428 - protein, 567 aa, Arabidopsis thaliana
  G760
MGRGSVTSLAPGFRFHPTDEELVRYYLKRKVCNKPFKFDAISVTDIYKSEPWDLPDKSKLKSRDLEWYFFSMLDKKYSNGSKTNRATEKGYWKTTGKDREIRNGSRVVGMKKTLVYHKGRAPRGERTNWVMHEYRLSDEDLKKAGVPQEAYVLCRIFQKSGTGPKNGEQYGAPYLEEEWEEDGMTYVPAQDAFSEGLALNDDVYVDIDDIDEKPENLVVYDAVPILPNYCHGESSNNVESGNYSDSGNYIQPGNNVVDSGGYFEQPIETFEEDRKPIIREGSIQPCSLFPEEQIGCGVQDENVVNLESSNNNVFVADTCYSDIPIDHNYLPDEPFMDPNNNLPLNDGLYLETNDLSCAQQDDFNFEDYLSFFDDEGLTFDDSLLMGPEDFLPNQEALDQKPAPKELEKEVAGGKEAVEEKESGEGSSSKQDTDFKDFDSAPKYPFLKKTSHMLGAIPTPSSFASQFQTKDAMRLHAAQSSGSVHVTAGMMRISNMTLAADSGMGWSYDKNGNLNVVLSFGVVQQDDAMTASGSKTGITATRAMLVFMCLWVLLLSVSFKIVTMVSAR

SEQ ID NO: 429 - DNA, 1324 bp, Arabidopsis thaliana
  G773
tccgggcaggtcttcaatctcagaaggcaaaaaagaaaatcaaagaagatagttttgtgattgttttctataaaaagtgcagatattttctttgtcctagagaaagaggtgataggaaaaatgggtctccaagagcttgacccgttagcccaattgagcttaccgccgggttttcggttttatccgactgacgaagagctgatggttgaatatctctgtagaaaagccgccggtcacgacttctctctccagctcatagctgaaatcgatctctacaagtttgatccatgggttttaccaagtaaggcgttattcggtgaaaaagaatggtattttttcagcccgagggataggaagtatccaaacgggtcaagacctaatcgggttgccgggtcgggttattggaaagccaccggtacggataaagttatctcgacggagggaagaagagttggtatcaagaaagctttggtgttttacattggaaaagctccaaaaggaaccaaaaccaattggattatgcatgagtaccgtctcatcgaaccctctcgtcgaaatggaagcaccaagcttgatgattgggttttatgtcgaatatacaaaaagcaaacaagcgcacaaaaacaagcttacaataatctaatgacgagtggtcgtgaatacagcaacaatggttcgtcgacatcttcttcgtctcatcaatacgacgacgttctcgagtcgttgcatgagattgacaacagaagtttggggtttgccgccggttcatcaaacgcgctgcctcatagtcatagaccggttttaaccaatcataaaaccgggtttcagggtttagccagggagccaagttttgattgggcgaatttgattggacagaactcggtcccggaactcggactgagtcataacgttccgagtattcgttacggtgacggtggaacgcagcaacaaactgaggggattcctcggtttaataataactcggacgtctcggctaatcagggttttagtgttgacccggttaacggatttgggtactcgggtcaacaatctagtgggttcgggtttatttgattgtgtaatggtaacgtaataagaaaaacatatttttattttttgtccgtgtcagattagttaattaatatagcgtagaattcgaactctagggttagatttaggttctacgacttgtattgtatattcgtcgtcatttgtcctgacatttacatttttgtaaacttttatagctggaacttttgtattgatcaattatttattagaaaaacagatattgcattggatctataaaaaaaaaaaaaaaaaa

SEQ ID NO: 430 - protein, 317 aa, Arabidopsis thaliana
  G773
MGLQELDPLAQLSLPPGFRFYPTDEELMVEYLCRKAAGHDFSLQLIAEIDLYKFDPWVLPSKALFGEKEWYFFSPRDRKYPNGSRPNRVAGSGYWKATGTDKVISTEGRRVGIKKALVFYIGKAPKGTKTNWIMHEYRLIEPSRRNGSTKLDDWVLCRIYKKQTSAQKQAYNNLMTSGREYSNNGSSTSSSSHQYDDVLESLHEIDNRSLGFAAGSSNALPHSHRPVLTNHKTGFQGLAREPSFDWANLIGQNSVPELGLSHNVPSIRYGDGGTQQQTEGIPRFNNNSDVSANQGFSVDPVNGFGYSGQQSSGFGFI

SEQ ID NO: 431 - DNA, 1199 bp, Arabidopsis thaliana
  G937
tggaaaaagtttgagtttttaattcgaatcgagaaaaaataaaaatgggttctttaggtgatgagcttagtttgggatcgatctttgggagaggagtttcgatgaatgttgtggcggttgagaaagttgatgaacatgttaagaagcttgaagaagagaagagaaagctcgaaagttgtcaacttgagcttcctctgtctttgcagattttaaacgatgcgattttgtatctgaaggataagagatgttcagagatggagactcaaccattgttgaaagatttcatttctgttaataaacctattcaaggagaaagaggaatagaattgctgaaaagagaggagctaatgagggagaagaagtttcagcaatggaaagctaatgatgatcacactagtaagatcaagagcaagcttgagattaagagaaatgaggagaaatctcctatgttgttgattccaaaggtggaaactggtttaggcctcggtttaagttcgagttcgataagaagaaaagggattgttgcctcatgtggctttacttctaactctatgccacaaccaccaacaccagcagtaccacaacaaccagcatttcttaagcagcaagctttacggaagcaaagaaggtgttggaatccagagttgcatcgccgatttgtcgatgcattgcaacagctaggtggaccgggagtggcaactcctaaacaaattagagaacatatgcaagaagaaggcttaaccaatgatgaagtcaagagtcatttacagaaatacaggttacacatcaggaagccaaattcgaatgcggagaaacaatcagcagttgttttagggtttaacttgtggaattcttcagcacaagatgaagaagagacatgtgaaggaggagaatcattgaagagaagcaatgcgcaatcagattctcctcaaggtcctttgcagttaccgtctacaacaacaacaactggtggagatagtagcatggaagatgttgaagatgctaagtctgagagctttcaactggagagattgagatcaccataaatctcaagaaaccaaactcttgatcacggttttgttattttggattcattactatatctattagtagtgaatgagaacaataattatagaaaggtttatagatatatatatagagaaaaagagagagtgaggatggttcaaattatttgcaga

SEQ ID NO: 432 - protein, 333 aa, Arabidopsis thaliana
  G937
MGSLGDELSLGSIFGRGVSMNVVAVEKVDEHVKKLEEEKRKLESCQLELPLSLQILNDAILYLKDKRCSEMETQPLLKDFISVNKPIQGERGIELLKREELMREKKFQQWKANDDHTSKIKSKLEIKRNEEKSPMLLIPKVETGLGLGLSSSSIRRKGIVASCGFTSNSMPQPPTPAVPQQPAFLKQQALRKQRRCWNPELHRRFVDALQQLGGPGVATPKQIREHMQEEGLTNDEVKSHLQKYRLHIRKPNSNAEKQSAVVLGFNLWNSSAQDEEETCEGGESLKRSNAQSDSPQGPLQLPSTTTTTGGDSSMEDVEDAKSESFQLERLRSP

SEQ ID NO: 433 - DNA, 1303 bp, Arabidopsis thaliana
  G971
ttttttttcttccctcttttagaactctctctctctctcgtttttgacacttatcctctctcttttttctctctccctctctctctggccggaaaaaagaacaacgtcgtttatagctaaagattcgatcatgttggatcttaacctaaagatcttttcttcttataacgaagatcaagatcggaaagtaccattaatgatctcaaccaccggtgaagaagaatctaactcatcttcctcctccacaacagactctgcagcgagagatgctttcatcgcttttggaattctcaaacgcgacgatgaccttgttcctcctcctcctcctcctcctcataaagaaacaggagatctctttccggtggtggctgatgctcgtcggaatatagaattctccgtggaagacagtcactggttgaatctttcttctttacaaagaaatacacagaaaatggtgaagaagagcagaagaggaccaaggtctcgtagctcccaatatcgtggcgtcactttttaccgtcgcaccggtcgttgggaatctcatatttgggattgtggaaagcaagtttatttgggcgggtttgatactgcttacgcagcagcaagggcttacgaccgagctgctatcaaattccgtggtctcgatgcagacatcaatttcgtcgtggatgattataggcatgacatcgataagatgaagaatttaaataaggtggagttcgtgcaaacacttaggcgagagagtgcgagtttcggaagaggaagttccaaatacaaaggcttggctcttcaaaaatgcacccaattcaaaactcatgatcagattcatctcttccaaaacaggggatgggatgcagcagcaataaaatacaatgagttgggaaagggagaaggagccatgaagtttggtgcccatatcaaaggaaatggtcacaatgatcttgaactaagtctcggaatttcatcatcatcggaaagtataaagttgacaacaggcgattactataagggtatcaatcggtccacgatgggtttatacggtaagcaatcatcgatatttttacccatggcaaccatgaaacctctgaagacagttgcagcatcatcaggattcccttttatcagcatgacaagttcctcttcctccatgtccaattgttttgatccataggatcgttctacactctcttaactaatatatatttttactctatctgattattgtatacaaggataaaatttgattctttccttaatgagtgagaaatattggaagtgttaaaaaaaaaaaaaaaaaaaaaaa

SEQ ID NO: 434 - protein, 346 aa, Arabidopsis thaliana
  G971
MLDLNLKIFSSYNEDQDRKVPLMISTTGEEESNSSSSSTTDSAARDAFIAFGILKRDDDLVPPPPPPPHKETGDLFPVVADARRNIEFSVEDSHWLNLSSLQRNTQKMVKKSRRGPRSRSSQYRGVTFYRRTGRWESHIWDCGKQVYLGGFDTAYAAARAYDRAAIKFRGLDADINFVVDDYRHDIDKMKNLNKVEFVQTLRRESASFGRGSSKYKGLALQKCTQFKTHDQIHLFQNRGWDAAAIKYNELGKGEGAMKFGAHIKGNGHNDLELSLGISSSSESIKLTTGDYYKGINRSTMGLYGKQSSIFLPMATMKPLKTVAASSGFPFISMTSSSSSMSNCFDP

SEQ ID NO: 435 - DNA, 1338 bp, Arabidopsis thaliana
  G988
atgcttacttccttcaaatcctctagctcctcctccgaagatgccaccgctaccaccaccgagaatcctcctcctttgtgcatcgcctcctcctcggccgcaacctccgcctcacatcacctccgtcgtcttcttttcaccgctgcgaatttcgtctcccagtcaaacttcaccgccgctcaaaacttactctcaatcctctcccttaactcttctcctcacggcgactccaccgagcgacttgtacacctcttcactaaagccttgtccgtacgaatcaaccgtcagcaacaagatcagacggctgaaacggttgccacgtggacgacgaacgaaatgacgatgagtaactccacggtgttcacgagcagtgtatgcaaagaacagttcttgtttcgaaccaagaacaacaattctgacttcgagtcttgttactatctttggctaaaccaactaacgccgtttattcggttcggtcatttaacggcgaaccaagctatcctcgacgcgacggagacaaacgataacggagctctacatatacttgatttagatatatcacaaggacttcaatggcctccattgatgcaagccctagcagagaggtcatcaaaccctagcagtccacctccatctctccgcataaccggatgcggtcgagatgtaaccggattaaaccgaactggagaccggttaacccggttcgctgactctttaggtctccaattccagtttcacacgctagtgatcgtagaagaagatctcgccggacttttgctacagatccgattgttagctctctcagccgtacaaggagagaccattgccgtcaattgtgttcacttcctccacaaaatatttaacgacgatggagatatgatcggtcacttcttgtcagcgatcaagagcttaaactctagaatcgttacaatggcagagagagaagctaatcatggagatcactcgttcttgaatagattctctgaggcagtggatcattacatggcgatctttgattcgttggaagcgacgttgccgccaaatagccgagagagactaaccctagagcaacggtggttcggtaaggagattttggatgttgtggcggcggaagagacggagagaaagcaaagacatcggaggtttgagatttgggaagagatgatgaagaggtttggtttcgttaacgttcctattggaagctttgctttgtctcaagctaagcttcttcttagacttcattatccttcagaaggttataatcttcagttccttaacaattctttgtttcttggctggcaaaatcgtcccctcttctccgtttcgtcgtggaaatga

SEQ ID NO: 436 - protein, 445 aa, Arabidopsis thaliana
  G988
MLTSFKSSSSSSEDATATTTENPPPLCIASSSAATSASHHLRRLLFTAANFVSQSNFTAAQNLLSILSLNSSPHGDSTERLVHLFTKALSVRINRQQQDQTAETVATWTTNEMTMSNSTVFTSSVCKEQFLFRTKNNNSDFESCYYLWLNQLTPFIRFGHLTANQAILDATETNDNGALHILDLDISQGLQWPPLMQALAERSSNPSSPPPSLRITGCGRDVTGLNRTGDRLTRFADSLGLQFQFHTLVIVEEDLAGLLLQIRLLALSAVQGETIAVNCVHFLHKIFNDDGDMIGHFLSAIKSLNSRIVTMAEREANHGDHSFLNRFSEAVDHYMAIFDSLEATLPPNSRERLTLEQRWFGKEILDVVAAEETERKQRHRRFEIWEEMMKRFGFVNVPIGSFALSQAKLLLRLHYPSEGYNLQFLNNSLFLGWQNRPLFSVSSWK

SEQ ID NO: 437 - DNA, 1218 bp, Arabidopsis thaliana
  G989
atgactacaaaacgcatagacagagatctcccatcttccgacgatccttcctccgctaaacgccgtatcgaattccccgaagaaacactcgaaaacgacggtgctgccgcaatcaaactccttagcttactcctccaatgcgccgaatacgtagctactgatcatctccgtgaagcttcaacacttttatccgaaatctccgagatatgttctccgttcggttcctcgccggagcgagtcgtcgcttacttcgctcaagcgctacaaacgcgcgtgatcagctcttacctctccggcgcgtgttctcccctctccgagaaaccactcactgttgttcagtctcagaaaatcttctccgccttgcagacttataactccgttagtcctctgatcaaattctcacatttcacggcgaatcaagccatttttcaggcgcttgacggagaagattccgttcatatcatcgatctcgatgttatgcaaggtcttcaatggccggctctatttcacatcctcgcttcacgtcctcgaaaactccgatcaattcgaatcaccggatttggttcctcctccgatctactcgcttcaactggccggagactcgccgatttcgcatcatcgttaaacctccctttcgaatttcatccaattgaaggcataatcggaaacctaatcgatccgagccaactcgcaacgagacaaggagaagctgtggtggttcattggatgcagcaccggttatatgatgttacagggaacaatctcgagacgttggagattctacggaggctgaaaccgaatctgatcacggtggtggagcaagaattgagctacgacgatggaggaagctttttaggaagattcgtggaggctttgcattattatagcgcgttgtttgacgcgctaggagatggattgggtgaagagagtggtgagagattcacggtggagcagattgttttggggacggagataagaaacattgtggcgcacggaggaggaagaaggaagagaatgaagtggaaagaagaactgagccgggtcgggtttagacctgtttcgcttcggggtaacccggcgacacaagcgggtttattgttgggtatgttaccgtggaatggatatactttggttgaagagaatggaaccctccgtcttggctggaaggatctctcgcttttgactgcctctgcctggaaatctcagccgttcgattga

SEQ ID NO: 438 - protein, 405 aa, Arabidopsis thaliana
  G989
MTTKRIDRDLPSSDDPSSAKRRIEFPEETLENDGAAAIKLLSLLLQCAEYVATDHLREASTLLSEISEICSPFGSSPERVVAYFAQALQTRVISSYLSGACSPLSEKPLTVVQSQKIFSALQTYNSVSPLIKFSHFTANQAIFQALDGEDSVHIIDLDVMQGLQWPALFHILASRPRKLRSIRITGFGSSSDLLASTGRRLADFASSLNLPFEFHPIEGIIGNLIDPSQLATRQGEAVVVHWMQHRLYDVTGNNLETLEILRRLKPNLITVVEQELSYDDGGSFLGRFVEALHYYSALFDALGDGLGEESGERFTVEQIVLGTEIRNIVAHGGGRRKRMKWKEELSRVGFRPVSLRGNPATQAGLLLGMLPWNGYTLVEENGTLRLGWKDLSLLTASAWKSQPFD

SEQ ID NO: 439 - DNA, 838 bp, Arabidopsis thaliana
  G1090
aaactaattcgcacagttctatatacactcacaaacacacacacacacaatatagtgctactaaaataaccttgtattaattatggaaaacacttacgttggccaacgagattaccgcttcaacgttaaccagttgtcctacagaggcattcgtcggaggaaatggggcaaatgggtatcggagatccgagaacccggtaagaaaacaaggatttggcttggaagctacgagacggccgagatggctgcagcggcctacgatgctgcggctcttcacctccgaggacgtgggaccaatctcaactttccggaactcgtcgacagttttcctcggccggaaagctctagttcggagcacattcaagcggctgcacaagatgcagcacttatgtttaaaccaggtaggttgagtgaaccagctctcgagtctggtcaaggactttctcgagtaggattgtctccggatcagattcaagcgattaatgagtctccattagactcgccgaggatggggtggatgcaggatttggaagttgctgactacgaagaattatacggacaattttttggtcagcacgatagggatgagttttttgaaatgcagcaatttcagtccatatggaattctaataattgatatacgttcgcttaattgcttaaccatttgattttttttttaataatgtcatatcatcaaccaaggtttttcgattatattcagtaaagtataataaattttcgacccttactgtttttcttgggttcaatttgtaatctcttaacaatgatgatgtcataaataccaatatgattaattcaaattttcaaaaaaaaaaaa

SEQ ID NO: 440 - protein, 184 aa, Arabidopsis thaliana
  G1090
MENTYVGQRDYRFNVNQLSYRGIRRRKWGKWVSEIREPGKKTRIWLGSYETAEMAAAAYDAAALHLRGRGTNLNFPELVDSFPRPESSSSEHIQAAAQDAALMFKPGRLSEPALESGQGLSRVGLSPDQIQAINESPLDSPRMGWMQDLEVADYEELYGQFFGQHDRDEFFEMQQFQSIWNSNN

SEQ ID NO: 441 - DNA, 1011 bp, Arabidopsis thaliana
  G1322
aaagttattgatagtttctgttacttattaatttttaaggttatgtgtattattaccaattggaggactatatagtcgcaagtctcaaccctataaaagaaaacattcgtcgatcatcttcccgcctcgagtatctctctctctctctctcttctctgttttctttattgattgcatagacaaaaatacacacatacacaacagaaagaaagatggagacgacgatgaagaagaaagggagagtgaaagcgacaataacgtcacagaaagaagaagaaggaacagtgagaaaaggaccttggactatggaagaagatttcatcctctttaattacatccttaatcatggtgaaggtctttggaactctgtcgccaaagcctctggtctaaaacgtactggaaaaagttgtcggctccggtggctgaactatctccgaccagatgtgcggcgagggaacataaccgaagaagaacagcttttgatcattcagcttcatgctaagcttggaaacaggtggtcgaagattgcgaagcatcttccgggaagaacggacaacgagataaagaacttctggaggacaaagattcagagacacatgaaagtgtcatcggaaaatatgatgaatcatcaacatcattgttcgggaaactcacagagctcggggatgacgacgcaaggcagctccggcaaagccatagacacggctgagagcttctctcaggcgaagacgacgacgtttaatgtggtggaacaacagtcaaacgagaattactggaacgttgaagatctgtggcccgtccacttgcttaatggtgaccaccatgtgatttaagatatatatatagacctcctatacatttatatgccccagctgggtttttttgtatggtacgttatttggtttttctattgctgaaatgtcgttgcatttaatttacatacgaaaagtgcattaaatcattaaatcttcaatacatatggaggtggtgtttgagtaaaaaaaaaaaaaa

SEQ ID NO: 442 - protein, 206 aa, Arabidopsis thaliana
  G1322
METTMKKKGRVKATITSQKEEEGTVRKGPWTMEEDFILFNYILNHGEGLWNSVAKASGLKRTGKSCRLRWLNYLRPDVRRGNITEEEQLLIIQLHAKLGNRWSKIAKHLPGRTDNEIKNFWRTKIQRHMKVSSENMMNHQHHCSGNSQSSGMTTQGSSGKAIDTAESFSQAKTTTFNVVEQQSNENYWNVEDLWPVHLLNGDHHVI

SEQ ID NO: 443 - DNA, 816 bp, Arabidopsis thaliana
  G1587
atgggctacatctccaacaacaacctcatcaactatttgcccctctctactactcaacctcctcttcttctcacccactgtgatattaacggcaatgatcaccatcagctcataaccgcatcatcaggagaacacgatattgatgaacggaaaaacaacattcctgcggcggcgactttgagatggaatccgacgccagagcagatcacgacgctagaagagctttacagaagcggaacacggacgccgacgacggaacagatccaacagatagcatctaagcttcgtaaatatgggagaatcgaagggaagaacgttttctattggtttcagaatcataaggctagagagagactaaaacgccgccgtcgtgaaggtggtgctattatcaaaccacataaagacgtcaaggattcatcatcaggtggtcatcgagttgatcagacaaagctctgcccatcttttccacacacaaaccgaccacagccacagcatgaattagatcctgcgagttacaataaagacaacaatgctaataatgaagatcatgggacgactgaagaatctgatcagagggcatcagaggttggtaaatacgccacatggagaaatcttgttacttggtcgataactcaacaaccggaagagattaatatcgacgaaaatgtcaacggagaagaagaagaaacgagggacaaccggactttaaatctctttccggttagggagtaccaagagaaaacaggccggttgatagagaagacgaaagcatgcaactactgttactactacgagttcatgcctctgaagaactga

SEQ ID NO: 444 - protein, 271 aa, Arabidopsis thaliana
  G1587
MGYISNNNLINYLPLSTTQPPLLLTHCDINGNDHHQLITASSGEHDIDERKNNIPAAATLRWNPTPEQITTLEELYRSGTRTPTTEQIQQIASKLRKYGRIEGKNVFYWFQNHKARERLKRRRREGGAIIKPHKDVKDSSSGGHRVDQTKLCPSFPHTNRPQPQHELDPASYNKDNNANNEDHGTTEESDQRASEVGKYATWRNLVTWSITQQPEEINIDENVNGEEEETRDNRTLNLFPVREYQEKTGRLIEKTKACNYCYYYEFMPLKN

SEQ ID NO: 445 - DNA, 1891 bp, Arabidopsis thaliana
  G1666
catcatgagcgtatgagagtaaattcttctcacatattaataacaacccttcaaagttataagatttttagagagagagctaccacgttttcgtatctccgggaacgatggatgaatcaagtattattccggcagagaaagtggccggagctgagaaaaaagagcttcaagggctgcttaagacggcggttcaatctgtggactggacttatagtgtcttctggcaattttgtcctcaacaacgggtcttggtgtgggggaatggatactacaacggtgcaataaagacgaggaagacaactcaaccagcggaggtgacggcagaagaggcggcgttagagaggagccaacagctcagggagctttatgagacacttttagccggagagtcaacgtcagaagcaagagcatgcaccgcattgtcaccggaggatttgacggagacagaatggttttatctaatgtgcgtctctttctcttttcctcctccatctgggatgccaggaaaagcgtatgcaaggaggaagcacgtatggctaagtggtgcaaatgaagttgacagtaaaactttttctagagctattctcgctaagagtgctaaaattcagacagtggtttgcattccaatgcttgatggtgttgtggaactaggcacaacgaaaaaggtaagagaagatgtagagtttgttgagctcacaaagagtttcttctatgaccactgcaagacgaacccaaagccggctctttctgaacactccacctacgaagtgcatgaagaagccgaagacgaagaagaagtagaagaagagatgacaatgtcagaggaaatgaggcttggctctcctgatgatgaagatgtttccaatcaaaatctacactctgatcttcatattgaatcaacccatacgttagacacacatatggacatgatgaatctaatggaggaaggtggaaactattctcagacagtaacaacacttctcatgtcacaccccacaagtcttctttcagattcagtttccacatcttcttacatccaatcatcgtttgccacgtggagggttgagaatggcaaagagcatcagcaagtgaaaacggcgccgtcgtcacaatgggtgctcaaacaaatgatcttcagagttcctttcctccatgacaacactaaagataagaggctaccgcgggaagatctgagccacgtagtagcagagcgacgcaggagggagaagctgaacgagaaattcataacgttgagatcaatggttccatttgtgaccaagatggataaagtctcaatccttggagacaccattgcgtacgtaaatcatcttcgaaagagggtccatgagcttgagaatactcatcatgagcaacagcataagcggacgcgtacttgtaagagaaaaacatcggaggaggtggaggtttccatcatagagaatgatgttttgttagagatgagatgtgagtaccgagatggtttgttgcttgacattcttcaggttcttcatgagcttggtatagagactacggcagttcatacctcggtgaacgaccatgatttcgaggcggagataagggcgaaagtaagagggaagaaagcaagcatcgctgaggtcaaaagagccatccaccaagtcataatacatgatactaatctatagaccctaactttattgatgccaactctagagaaggataattaagcgtatttttgttttagcctcacatgtattaagacatcagttacatatatagccggatgcaacatataaatgaaaatgtactagatgatattgttcatttgtccaatgtagtacttgtgtatgatgcaattgcaacatataaatgcaaatgtactagatgacgatgttgttcgttgtccaattta

SEQ ID NO: 446 - protein, 518 aa, Arabidopsis thaliana
  G1666
MDESSIIPAEKVAGAEKKELQGLLKTAVQSVDWTYSVFWQFCPQQRVLVWGNGYYNGAIKTRKTTQPAEVTAEEAALERSQQLRELYETLLAGESTSEARACTALSPEDLTETEWFYLMCVSFSFPPPSGMPGKAYARRKHVWLSGANEVDSKTFSRAILAKSAKIQTVVCIPMLDGVVELGTTKKVREDVEFVELTKSFFYDHCKTNPKPALSEHSTYEVHEEAEDEEEVEEEMTMSEEMRLGSPDDEDVSNQNLHSDLHIESTHTLDTHMDMMNLMEEGGNYSQTVTTLLMSHPTSLLSDSVSTSSYIQSSFATWRVENGKEHQQVKTAPSSQWVLKQMIFRVPFLHDNTKDKRLPREDLSHVVAERRRREKLNEKFITLRSMVPFVTKMDKVSILGDTIAYVNHLRKRVHELENTHHEQQHKRTRTCKRKTSEEVEVSIIENDVLLEMRCEYRDGLLLDILQVLHELGIETTAVHTSVNDHDFEAEIRAKVRGKKASIAEVKRAIHQVIIHDTNL

SEQ ID NO: 447 - DNA, 711 bp, Arabidopsis thaliana
  G1700
atgtcttacagtgacccaaaccaaaacccgattccagaaacttacgctccatcaaactcaactgaatcagagaaactgaaactttaccaagcttttatcttctctgttccaatctgtttcacattcatcgttctcttcgttctttacgtcatttaccttcgtcgaaacagcaccaccaatgttgattggtcttctcttggcatgcgtggtggtacctttgtccccaccaacaacaatctctcaacggctgaattaggactgagcaaagatattagagagatgcttcctgttgtcatctacaaggagagtttcatagtcaaagattcacaatgttcagtgtgtcttggggactaccaagcagaagagaaactccaacaaatgccatcatgtgggcacacttttcacatggaatgtattgatctatggctcacatcacacacaacatgccctctttgtcgtctctctcttatccccaaaccgtccctagacctgtcccatcaaagcacagagattgtctcttccatagaaaactctaatggaggagaagcttcaactcaaccagattcccagtcagcaaccgaagcaataagtcacaccgatgatgtcgaagaaggtaaccgagatagtcaagaggtctctaaggagacggaagagaatgaccgaaacagcgtagggacatctgatggttgttgtacttgtagacttggttaa

SEQ ID NO: 448 - protein, 236 aa, Arabidopsis thaliana
  G1700
MSYSDPNQNPIPETYAPSNSTESEKLKLYQAFIFSVPICFTFIVLFVLYVIYLRRNSTTNVDWSSLGMRGGTFVPTNNNLSTAELGLSKDIREMLPVVIYKESFIVKDSQCSVCLGDYQAEEKLQQMPSCGHTFHMECIDLWLTSHTTCPLCRLSLIPKPSLDLSHQSTEIVSSIENSNGGEASTQPDSQSATEAISHTDDVEEGNRDSQEVSKETEENDRNSVGTSDGCCTCRLG

SEQ ID NO: 449 - DNA, 1740 bp, Arabidopsis thaliana
  G1818
taacaaatcaaataattagagaaataaccaaaatttaacttttagagggactacaggatttgtactttgtacattcatatattattgttatatatcgtttcatacattaatttgaaccaatgtaaattaagtaaaattcaatttaacatcatgagcaaattcttattaaaattctcttaaaattttgagcaaattatgctttcacatttaacatttgaaaacatcatttttaacaagatattcaaaactaagttttgtacagcaaaattttaactttcaattttatagagaaaaaggtatttttttttttgtttcatttttataagactattatttggtatataatatacactttaagtaaaaacaaatctctttcttttttcttcttataataccaaccacaagtctgtcagtcacacacatacagttaataacattaaatattcttaacaaactactaaataggttgagattcatatatgtaaagagatcacttcttaatcttatcctaccatatcttatatacgcttaattttcctttatatatgcaaacctccacataaaaatatctcaaacccaaacacttcaaacaaaaaaaaaatggagaacaacaacaacaaccaccaacagccaccgaaagataacgagcaactaaagagtttctggtcaaaggggatggaaggtgacttgaatgtcaagaatcacgagttccccatctctcgtatcaagaggataatgaagtttgatccggatgtgagtatgatcgctgctgaggctccaaatctcttatctaaggcttgtgaaatgtttgtcatggacctcacgatgcgttcatggctccatgctcaagagagcaaccgactcacgatacggaaatctgatgttgatgccgtagtgtctcaaaccgtcatctttgatttcttgcgtgatgatgtccctaaggacgagggagagcccgttgtcgccgctgctgatcctgtggacgatgttgctgatcatgtggctgtgccagatcttaacaatgaagaactgccgccgggaacggtgataggaactccggtttgttacggtttaggaatacacgcgccacacccgcagatgcctggagcttggaccgaggaggatgcgactggggcaaatggaggaaacggtgggaattaatatttggattgggttttgtaaccgctgttgtgagaacttgaatttctttttgagttctgcttatgttttcaatgttatgttttttagttgttgaatgtatttctgttgttttgtccaaaaaaaaaaaagaatgtatttctgttgttgtctttcaaatgaatctaatggtttatgaatattggctttagattaatttatgcatacaaaaacacaaggattacggataaaaaagtcctcagtttacccatggaaacataatcttctagtgattccttatgagagtagaaaagaatcatatattataatctatttcataagagatagggtactgtaaacaaggatgtttattcggctatttcttttttttttaatcacttttacttgtcaagactcttttgtgtttgcagctttttgttagattacattctagaggcaacaagatccagagatctagcaaaaaaaacttattttgaaacctgaatctattttaaaaattttccaactcatttttcgttcttattctttgttttccaacggaatttggcgcacaaacgatttatttgaattttgtctttcaag

SEQ ID NO: 450 - protein, 186 aa, Arabidopsis thaliana
  G1818
MENNNNNHQQPPKDNEQLKSFWSKGMEGDLNVKNHEFPISRIKRIMKFDPDVSMIAAEAPNLLSKACEMFVMDLTMRSWLHAQESNRLTIRKSDVDAVVSQTVIFDFLRDDVPKDEGEPVVAAADPVDDVADHVAVPDLNNEELPPGTVIGTPVCYGLGIHAPHPQMPGAWTEEDATGANGGNGGN

SEQ ID NO: 451 - DNA, 1774 bp, Arabidopsis thaliana
  G1868
tcccatggcaactatctctcaagtcattatctaactttttttccttctttttctttttatattacttacttcttatggatattggtgttcatgttcttgggtcggttactagtaatgaaaatgagtcacttggtctaaaagagcttataggaactaaacaagatagatccggattcatcggtgaggattgcttgcaacgaagcttgaagctagcaagaacgacaactagagcggaagaagaagaaaacttgtcttcttctgttgcagctgcttattgcaaaacgatgtcgtttcaccaaggcattcctctcatgagatctgcttctcctctttcctctgattctcgccgtcaagaacaaatgcttagcttctcagataaaccagacgctcttgatttcagtaaatatgtcggtttggataatagcagtaataacaagaactctctctcgccgtttcttcaccagattcctccaccttcttactttagaagctcaggaggatatggttctggtggaatgatgatgaacatgagcatgcaagggaacttcacaggtgttaaaggaccttttacattgactcaatgggctgagttagagcaacaggcgttgatctataagtacatcacagccaatgtccctgttccttctagtttgctcatctctatcaagaagtctttttatccttacggatctttgcctcctagttccttcggatggggaactttccatctcggtttcgcaggcggtaacatggaccctgagccagggagatgccgcagaacagatgggaagaaatggcggtgctcaagagacgccgttcctgatcagaaatactgtgaaagacacatcaacagaggccgtcatcgttcaagaaagcctgtggaagtccaatctggccaaaaccaaaccgccgctgctgcatccaaagcggttactacaccacaacagcctgttgtcgctggtaatactaacagaagcaatgcccgtgcatcaagcaaccgcagcctcgccattggaagtcaatatatcaatccttctacagaatctttacctaacaacagaggagtttcgatatatccttccaccgtcaacttacaacccaaggaatctccggttattcatcagaaacacagaaacaacaacaacccttttgagtttggacacaaatcctctgattcgttactcaacccgaataccgcaaagacctatggatcatcgttcttggatttcagcagcaaccaagagaagcattcagggaatcacaatcacaattcttggcctgaagagctgacatcagattggacacagctctcaatgtcaattccaatagcatcatcatccccttcctccacacacaacaacaacaatgctcaagaaaaaacaacactctcgcctctcaggctatcccgcgagcttgacctatcgatccaaaccgatgaaacaacaatcgagcctactgtgaaaaaggtgaatacttggataccaatctcatggggaaactccttaggaggtcctctaggtgaagtactaaacagtacaacgaatagtccaacatttggatcttctcctacaggggttttgcaaaagtccacattttgttcactctctaacaacagctccgtgagcagccccattgcagagaacaacagacacaatggcgattactttcattacacaacctgaaaactgaaaccaagtcctgcggcaggaaacaaaaaaagaaaagctctgttttttctctttcattatgttctgtttcgtctttctaaagctgc

SEQ ID NO: 452 - protein, 535 aa, Arabidopsis thaliana
  G1868
MDIGVHVLGSVTSNENESLGLKELIGTKQDRSGFIGEDCLQRSLKLARTTTRAEEEENLSSSVAAAYCKTMSFHQGIPLMRSASPLSSDSRRQEQMLSFSDKPDALDFSKYVGLDNSSNNKNSLSPFLHQIPPPSYFRSSGGYGSGGMMMNMSMQGNFTGVKGPFTLTQWAELEQQALIYKYITANVPVPSSLLISIKKSFYPYGSLPPSSFGWGTFHLGFAGGNMDPEPGRCRRTDGKKWRCSRDAVPDQKYCERHINRGRHRSRKPVEVQSGQNQTAAAASKAVTTPQQPVVAGNTNRSNARASSNRSLAIGSQYINPSTESLPNNRGVSIYPSTVNLQPKESPVIHQKHRNNNNPFEFGHKSSDSLLNPNTAKTYGSSFLDFSSNQEKHSGNHNHNSWPEELTSDWTQLSMSIPIASSSPSSTHNNNNAQEKTTLSPLRLSRELDLSIQTDETTIEPTVKKVNTWIPISWGNSLGGPLGEVLNSTTNSPTFGSSPTGVLQKSTFCSLSNNSSVSSPIAENNRHNGDYFHYTT

SEQ ID NO: 453 - DNA, 729 bp, Arabidopsis thaliana
  G1888
atgaagatttggtgtgctgtttgtgataaagaagaagcttcggtgttttgttgtgcggatgaagcagctctttgtaatggttgcgatcgccatgttcatttcgccaataaactagccgggaaacatctccggttctctctcacttctcctactttcaaagatgctcctctttgtgatatttgcggggagaggcgtgcattattattttgccaagaagacagagcaatactatgcagagaatgtgacattccaatacatcaagctaatgagcacactaagaaacacaatagattcctccttaccggcgttaagatctctgcctccccgtcagcctacccaagagcctccaattccaactctgctgctgcatttggtcgagccaaaacccgaccaaaatcagtatcgagcgaggtcccgagctcggcctccaatgaggtatttacgagctcttcttcgacgaccacgagcaattgctattatgggatagaagaaaactaccatcacgtgagcgattcggggtcgggatcgggttgtacaggtagtatatccgagtatttgatggagacattaccgggttggagagtggaggatttgcttgaacacccttcttgtgtctcctatgaggataacattattactaataacaataacagtgagtcttatagggtttatgatggttcttcacaattccatcatcaagggttttgggatcacaaacccttctcttga

SEQ ID NO: 454 - protein, 242 aa, Arabidopsis thaliana
  G1888
MKIWCAVCDKEEASVFCCADEAALCNGCDRHVHFANKLAGKHLRFSLTSPTFKDAPLCDICGERRALLFCQEDRAILCRECDIPIHQANEHTKKHNRFLLTGVKISASPSAYPRASNSNSAAAFGRAKTRPKSVSSEVPSSASNEVFTSSSSTTTSNCYYGIEENYHHVSDSGSGSGCTGSISEYLMETLPGWRVEDLLEHPSCVSYEDNIITNNNNSESYRVYDGSSQFHHQGFWDHKPFS

SEQ ID NO: 455 - DNA, 506 bp, Arabidopsis thaliana
  G2117
atacttgtcaacaaaaattttcttaaagaacgcataactgtttttttcatggctggttctgtctataaccttccaagtcaaaaccctaatccacagtctttattccaaatctttgttgatcgagtaccactttcaaacttgcctgccacgtcagacgactctagccggactgcagaagataatgagaggaagcggagaaggaaggtatcgaaccgcgagtcagctcggagatcgcgtatgcggaaacagcgtcacatggaagaactgtggtccatgcttgttcaactcatcaataagaacaaatctctagtcgatgagctaagccaagccagggaatgttacgagaaggttatagaagagaacatgaaacttcgagaggaaaactccaagtcgaggaagatgattggtgagatcgggcttaataggtttcttagcgtagaggccgatcagatctggaccttctaatcgtctcgtaagcttgttggttttttgttgtttatttaaag

SEQ ID NO: 456 - protein, 138 aa, Arabidopsis thaliana
  G2117
MAGSVYNLPSQNPNPQSLFQIFVDRVPLSNLPATSDDSSRTAEDNERKRRRKVSNRESARRSRMRKQRHMEELWSMLVQLINKNKSLVDELSQARECYEKVIEENMKLREENSKSRKMIGEIGLNRFLSVEADQIWTF

SEQ ID NO: 457 - DNA, 1065 bp, Arabidopsis thaliana
  G2131
gtctctcattttcataattccattttcaggattgtctctcaatcttttattcttctcattcaccggtaatggcaaaagtctctgggaggagcaagaaaacaatcgttgacgatgaaatcagcgataaaacagcgtctgcgtctgagtctgcgtccattgccttaacatccaaacgcaaacgtaagtcgccgcctcgaaacgctcctcttcaacgcagctccccttacagaggcgtcacaaggcatagatggactgggagatacgaagcgcatttgtgggataagaacagctggaacgatacacagaccaagaaaggacgtcaagtttatctaggggcttacgacgaagaagaagcagcagcacgtgcctacgacttagcagcattgaagtactggggacgagacacactcttgaacttccctttgccgagttatgacgaagacgtcaaagaaatggaaggccaatccaaggaagagtatattggatcattgagaagaaaaagtagtggattttctcgcggtgtatcaaaatacagaggcgttgcaaggcatcaccataatgggagatgggaagctagaattggaagggtgtttggtaataaatatctatatcttggaacatacgccacgcaagaagaagcagcaatcgcctacgacatcgcggcaatagagtaccgtggacttaacgccgttaccaatttcgacgtcagccgttatctaaaccctaacgccgccgcggataaagccgattccgattctaagcccattcgaagccctagtcgcgagcccgaatcgtcggatgataacaaatctccgaaatcagaggaagtaatcgaaccatctacatcgccggaagtgattccaactcgccggagcttccccgacgatatccagacgtattttgggtgtcaagattccggcaagttagcgactgaggaagacgtaatattcgattgtttcaattcttatataaatcctggcttctataacgagtttgattatggaccttaatcgtattttctacaagttttgttttgattatctacacaatacatcaatatattct

SEQ ID NO: 458 - protein, 313 aa, Arabidopsis thaliana
  G2131
MAKVSGRSKKTIVDDEISDKTASASESASIALTSKRKRKSPPRNAPLQRSSPYRGVTRHRWTGRYEAHLWDKNSWNDTQTKKGRQVYLGAYDEEEAAARAYDLAALKYWGRDTLLNFPLPSYDEDVKEMEGQSKEEYIGSLRRKSSGFSRGVSKYRGVARHHHNGRWEARIGRVFGNKYLYLGTYATQEEAAIAYDIAAIEYRGLNAVTNFDVSRYLNPNAAADKADSDSKPIRSPSREPESSDDNKSPKSEEVIEPSTSPEVIPTRRSFPDDIQTYFGCQDSGKLATEEDVIFDCFNSYINPGFYNEFDYGP

SEQ ID NO: 459 - DNA, 1197 bp, Arabidopsis thaliana
  G2520
aaggagttttgcatactcaccaagccacaatcatttctctcttctctatctctctggttttgaatcggcgacgactgagtcaactcggtgttgttactggtttcgtcgtatgtgttgtaactgattaagttgatggatccgagtgggatgatgaacgaaggaggaccgtttaatctagcggagatctggcagtttccgttgaacggagtttcaaccgccggagattcttctagaagaagcttcgttggaccgaatcagttcggtgatgctgatctaaccacagctgctaacggtgatccagcgcgtatgagtcacgcgttgtctcaggcggttattgaaggtatctccggcgcttggaaacggagggaagatgagtctaagtcggcgaagatcgtctccaccattggcgctagtgaaggtgagaacaaaagacagaagatagatgaagtgtgtgatgggaaagcagaagcagaatcgctaggaacagagacggaacaaaagaagcaacagatggaaccaacgaaagattatattcatgttcgagctagaagaggtcaagctactgatagtcacagtttagctgaaagagcgagaagagagaaaataagtgagcggatgaaaatcttgcaagatcttgttccgggatgtaacaaggttattggaaaagcacttgttctagatgagataattaactatatacaatcattgcaacgtcaagttgagttcttatcgatgaagcttgaagcagtcaactcaagaatgaaccctggtatcgaggtttttccacccaaagaggtgatgattctcatgatcatcaactcaatcttctccatttttttcacaaaacaatacatgtttctatcgaggtattctcggggtaggagtctcgatgtttatgcggttcggtcatttaagcattgcaataaacggagtgacctctgtttttgctcctgctccccaaaaacagaacttaagacaactatattttcacaaaacatgacatgtttctgtcgatattctcgagtaggagtcgctattagttcatctaagcattgcaatgaaccgtttggtcagcaagcgtttgagaatccggagatacagttcgggtcgcagtctacgagggaatacagtagaggagcatcaccagagtggttgcacatgcagataggatcaggtggtttcgaaagaacgtcttga

SEQ ID NO: 460 - protein, 354 aa, Arabidopsis thaliana
  G2520
MDPSGMMNEGGPFNLAEIWQFPLNGVSTAGDSSRRSFVGPNQFGDADLTTAANGDPARMSHALSQAVIEGISGAWKRREDESKSAKIVSTIGASEGENKRQKIDEVCDGKAEAESLGTETEQKKQQMEPTKDYIHVRARRGQATDSHSLAERARREKISERMKILQDLVPGCNKVIGKALVLDEIINYIQSLQRQVEFLSMKLEAVNSRMNPGIEVFPPKEVMILMIINSIFSIFFTKQYMFLSRYSRGRSLDVYAVRSFKHCNKRSDLCFCSCSPKTELKTTIFSQNMTCFCRYSRVGVAISSSKHCNEPFGQQAFENPEIQFGSQSTREYSRGASPEWLHMQIGSGGFERTS

SEQ ID NO: 461 - DNA, 1423 bp, Arabidopsis thaliana
  G2522
tcgaccggttgcatgttgttatcttgctcttgaagtctatcgaacccttttagattctgattttgttctcttcttatccctcctcctataagttagccatttagggtccccatcgaattttactaagttaaagtcagagtctttttggttaagctatggatcgaagagacgcaatggcgttatccgggtcgggttcttactatatccaaagaggaatccccggttctggtcctcctcctcctcaaactcaaccaacgtttcacggatcacaaggatttcatcatttcaccaattccatctctccttttgggtcaaacccaaacccaaatccaaaccctggaggtgtctctactggattcgtgtctcctcctttacccgttgactcttctccggctgattcgtcagcggcggcggcgggagctttggttgctcctccttcaggtgacacgtctgtgaagcggaagagaggacggcctagaaaatatggacaagatggtggttctgtttcgttggcattgtctccttctatctccaacgtttccccgaactctaacaaacgtggccgtggaagacctcctggctccggcaagaagcaacggctatcttccattggtgaaatgatgccttcatcaactgggatgagcttcacaccgcatgtaatcgtagtttccattggtgaagacattgcttcaaaggttatatcgttctcgcatcaaggtccacgagcgatatgtgtcttatccgcaagtggtgctgtctctactgcaactcttcttcagccagcaccttctcatggaactattatatacgagggtctattcgagctcatatctctctcaacttcttatctgaacacaactgacaatgactacccaaaccgcactggaagtctagcggtctcacttgctagccccgatggtcgtgtcattggtggtggaattggaggtcctctaatagcagcaagccaagtccaggtcattgttggcagcttcatttgggcaattccgaaagggaagattaaaaaacgtgaagaaacttctgaagatgtccaagatactgatgctttggaaaacaacaacgataacacagcagcaacgtcacctcctgttcctcagcaaagtcagaacattgttcagactcctgtaggcatttggtcaactggttcaaggtcaatggatatgcatcacccccatatggacattgatctaatgcgtggatgattcatgtatatataagcattgaatctaggagaagaagaagaaacttgagctaacctccctgaaacaaagtagtctattggtattgtttaggaaagaaaaagacaattagtaagtttaggaatttctgcgtgttttcgagctttcagttagttgatttggtctcttgacttgttatgaatgggaaaaaaaattgcttgtttctt

SEQ ID NO: 462 - protein, 354 aa, Arabidopsis thaliana
  G2522
MDRRDAMALSGSGSYYIQRGIPGSGPPPPQTQPTFHGSQGFHHFTNSISPFGSNPNPNPNPGGVSTGFVSPPLPVDSSPADSSAAAAGALVAPPSGDTSVKRKRGRPRKYGQDGGSVSLALSPSISNVSPNSNKRGRGRPPGSGKKQRLSSIGEMMPSSTGMSFTPHVIVVSIGEDIASKVISFSHQGPRAICVLSASGAVSTATLLQPAPSHGTIIYEGLFELISLSTSYLNTTDNDYPNRTGSLAVSLASPDGRVIGGGIGGPLIAASQVQVIVGSFIWAIPKGKIKKREETSEDVQDTDALENNNDNTAATSPPVPQQSQNIVQTPVGIWSTGSRSMDMHHPHMDIDLMRG

SEQ ID NO: 463 - DNA, 1713 bp, Arabidopsis thaliana
  G8
aaaaaaaaatatccgtctcactctctcgccgccggtaacatttcccggcgacaaaacttctctactctcaccattcctccatcgtaatctctaaattcttctccattctcttcttcctcccgatcatctcgagctcttcgtgagagattatgtgattatgtaatcgttgttgctgtagaagacgatctctaacaactgattccttcatcatcaccttcgctagatttgtaattttcagagcttgagatgttggatcttaacctcaacgctgattctcccgagtcgactcagtacggtggtgactcatacttagatcggcagacatcagacaactccgccgggaatcgagtggaagagtccggtacatcgacgtcgtcagttatcaatgccgatggagacgaagactcttgctctactcgagctttcactctcagtttcgatattttaaaagtcggaagtagtagcggcggagacgaaagccccgccgcttcagcttccgttactaaagagttttttccggtgagtggagactgtggacatctacgagatgttgaaggatcatcaagctctagaaactggatagatctttcttttgaccgtattggtgacggagaaacgaaattggtaactccggttccgactccggctccggttccggctcaggttaaaaagagtcggagaggaccaaggtctagaagttcacagtatagaggagttactttttatagaagaactggtcgatgggagtcacatatttgggattgtgggaaacaagtttatttaggtggtttcgacactgctcatgctgcagctagagcttatgatcgagctgctattaaatttagaggtgttgatgctgatatcaactttactcttggtgattatgaggaagatatgaaacaggtacaaaacttgagtaaggaagagtttgtgcatatactgcgtagacagagcacggggttttcgcgggggagttcgaagtatcgaggggttacgttacacaaatgtggtagatgggaagctaggatggggcagtttcttggtaaaaaggcttatgacaaggctgcaatcaacactaatggtagagaagcagtcacgaacttcgagatgagttcataccaaaatgagattaactctgagagcaataactctgagattgacctcaacttgggaatctctttatcgaccggtaatgcgccaaagcaaaatgggaggctctttcacttcccttctaatacttatgaaactcagcgtggagttagcttgaggatagataacgaatacatgggaaagccggtgaatacacctcttccttatggatcctcggatcatcgcctttactggaacggagcatgcccgagttataataatcccgccgagggaagagcaacagaaaagagaagtgaagctgaagggatgatgagtaactggggatggcagagaccggggcaaacaagcgccgtgagaccgcagccaccgggaccacaaccaccaccattgttctcagttgcagcagcatcatcaggattctcacatttccggccacaacctcccaatgacaatgcaacacgtggttacttttatccacacccttaacttgtaaggggacatatgagagtttttttaccatctctctctctctcaacactctagtcccctttcaaaaatgtcatttgggttttagatttttcacatacaatgatcaatttttcc

SEQ ID NO: 464 - protein, 449 aa, Arabidopsis thaliana
  G8
MLDLNLNADSPESTQYGGDSYLDRQTSDNSAGNRVEESGTSTSSVINADGDEDSCSTRAFTLSFDILKVGSSSGGDESPAASASVTKEFFPVSGDCGHLRDVEGSSSSRNWIDLSFDRIGDGETKLVTPVPTPAPVPAQVKKSRRGPRSRSSQYRGVTFYRRTGRWESHIWDCGKQVYLGGFDTAHAAARAYDRAAIKFRGVDADINFTLGDYEEDMKQVQNLSKEEFVHILRRQSTGFSRGSSKYRGVTLHKCGRWEARMGQFLGKKAYDKAAINTNGREAVTNFEMSSYQNEINSESNNSEIDLNLGISLSTGNAPKQNGRLFHFPSNTYETQRGVSLRIDNEYMGKPVNTPLPYGSSDHRLYWNGACPSYNNPAEGRATEKRSEAEGMMSNWGWQRPGQTSAVRPQPPGPQPPPLFSVAAASSGFSHFRPQPPNDNATRGYFYPHP

SEQ ID NO: 465 - DNA, 881 bp, Arabidopsis thaliana
  G27
caaaataccaaaaacaaaacattttttttaatcttcccaccaatttttttctctttctctcgttacattaaattatctttagatgcaagactcttcctctcacgaatcgcaacgtaacctccggtcaccggtgccggagaaaaccggaaagagttctaagactaaaaatgagcaaaaaggtgtttctaaacaaccaaattttcgtggggtcagaatgagacaatggggaaaatgggtgtctgaaattagagaaccaagaaagaaatcaagaatatggctcggtactttctctacgccggagatggcggcgcgtgcacacgacgtggcggctttagccatcaaaggtggctctgcccaccttaatttcccggagctagcttaccatttgccgagaccggctagcgcggaccctaaagacattcaagaagccgccgccgcagcagctgccgttgactggaaagcaccggagtctccgtctagcaccgtgacgtcatctccagtcgccgacgacgctttctccgatcttcctgatcttttgcttgacgtgaatgatcacaacaaaaacgatggattctgggactcgtttccgtacgaagatcctttcttcttggaaaattactagaaggcaaattcttgccggcgaacggattttccggtggtttcccggtaaataagaagacgatgtcgttttgtaccttttttgtctacgatgggaaatttcttttttttttacgtgtgagtaaaagtttccgaatgtgtgatgtgtaagtaagtacaggttatttaatttcttttttttgtacaaatacgtacgtcattaccaaaaagttttcatttattgtgcttttatcttccaaattcattaaaaaaaaaaaaaaaaa

SEQ ID NO: 466 - protein, 179 aa, Arabidopsis thaliana
  G27
MQDSSSHESQRNLRSPVPEKTGKSSKTKNEQKGVSKQPNFRGVRMRQWGKWVSEIREPRKKSRIWLGTFSTPEMAARAHDVAALAIKGGSAHLNFPELAYHLPRPASADPKDIQEAAAAAAAVDWKAPESPSSTVTSSPVADDAFSDLPDLLLDVNDHNKNDGFWDSFPYEDPFFLENY

SEQ ID NO: 467 - DNA, 947 bp, Arabidopsis thaliana
  misc_feature (924)..(925): n is a, c, g, or t
  misc_feature (929)..(929): n is a, c, g, or t
  misc_feature (932)..(933): n is a, c, g, or t
  G156
aggaagagggagccactcataagaggaagaagagagagatgggtagagggaagatagagataaagaagatagagaatcagacggcgaggcaagtgaccttctccaagagaagaactggtcttataaagaagactcgtgagctctctattctctgtgacgctcacatcggtctcatcgtcttctcagccaccggaaagctttccgagttctgctccgaacagaacaggatgcctcaactcattgaccgatacttgcataccaacggattgcgacttcctgatcatcatgacgaccaggagcaattgcaccatgagatggaactactaagaagagagacatgtaaccttgagcttcgtctgcgtccattccatggacatgacttagcctccattcctcctaatgagcttgacggactcgagagacagctagaacattctgtcctcaaagtccgtgagcgtaagaggaggatgctagaagaagataacaacaacatgtaccgttggcttcatgagcatcgtgcagcgatggagtttcaacaagctgggatagataccaaaccaggggagtatcaacagtttatagagcagcttcagtgctataaaccaggggagtatcagcagtttctagagcagcagcaacaacaaccaaacagcgttcttcagcttgctacacttccttctgagattgatcctacttacaatctccagcttgctcagcctaatcttcaaaacgatccaacggcccagaatgattaatacaattctcaatagatatctactctttctttatggagacagattcatgaacttttattacctatattttgataagccagtgtcttcttttgtgtggctatggaaaccttgtttaaagcacaatgcacttgagttcttggttatataattaatcatcattattacatannaaanaannaaaaaaaaaaaaaa

SEQ ID NO: 468 - protein, 238 aa, Arabidopsis thaliana
  G156
MGRGKIEIKKIENQTARQVTFSKRRTGLIKKTRELSILCDAHIGLIVFSATGKLSEFCSEQNRMPQLIDRYLHTNGLRLPDHHDDQEQLHHEMELLRRETCNLELRLRPFHGHDLASIPPNELDGLERQLEHSVLKVRERKRRMLEEDNNNMYRWLHEHRAAMEFQQAGIDTKPGEYQQFIEQLQCYKPGEYQQFLEQQQQQPNSVLQLATLPSEIDPTYNLQLAQPNLQNDPTAQND

SEQ ID NO: 469 - DNA, 1133 bp, Arabidopsis thaliana
  misc_feature (1131)..(1131): n is a, c, g, or t
  G161
tatattttagcttctcaaatatcactaaaaatggtgaaaaaaagcaaaggtcgtcaaaaaatagagatggtcaaaatgaaaaatgaaagtaaccttcaagttactttttcaaaaagaagatctggacttttcaaaaaggctagtgagctttgcacactttgtggtgcagaagtggccatagttgtgttctcacctggtcgaaaagtcttttcttttggtcatccaaatgttgattctgtaattgatcgattcataaacaataaccctctacctcctcaccaacacaacaacatgcaacttagagaaactcgtcgaaattcgattgttcaggatctgaataatcatcttactcaggtgttgagtcaattagaaacagagaaaaagaagtacgacgagttaaagaaaataagagaaaagacaaaagcccttgggaattggtgggaagatcccgttgaggaacttgcgttatctcaactcgaggggttcaaaggtaatcttgaaaatttgaagaaagtagttacagtcgaagcttccagattttttcaggcaaatgttccaaacttctatgtgggaagttctagtaataatgctgcttttgggattgatgatggtagtcatatcaaccctgatatggatctctttagccaaagaagaatgatggacataaatgccttcaactacaaccagaaccaaattcaccctaatcatgcattaccaccctttggaaacaatgcttatggtattaatgaagggtttgttccagaatacaatgtgaacttcagaccagagtataacccaaaccaaaaccaaatccaaaaccaaaatcaagttcaaatccaaatccaaaaccagagttttaagagagaaaacatctctgaatatgaacatcatcatggttatcctccccagtctagatctgattactattaaccctttgttgtgtgatccaacttaagtctctagacaaaaagttgtgtgtttaggttatctttatttcttcttatttatgtttctacatgtgttgttgttgtttttcttgttcttgtttaagtattatgttgtattgtgttgtttcatttcaaaattatgttattgctatatataaattatatgtgtcggaaacaaaaaaanaa

SEQ ID NO: 470 - protein, 299 aa, Arabidopsis thaliana
  G161
MVKKSKGRQKIEMVKMKNESNLQVTFSKRRSGLFKKASELCTLCGAEVAIVVFSPGRKVFSFGHPNVDSVIDRFINNNPLPPHQHNNMQLRETRRNSIVQDLNNHLTQVLSQLETEKKKYDELKKIREKTKALGNWWEDPVEELALSQLEGFKGNLENLKKVVTVEASRFFQANVPNFYVGSSSNNAAFGIDDGSHINPDMDLFSQRRMMDINAFNYNQNQIHPNHALPPFGNNAYGINEGFVPEYNVNFRPEYNPNQNQIQNQNQVQIQIQNQSFKRENISEYEHHHGYPPQSRSDYY

SEQ ID NO: 471 - DNA, 993 bp, Arabidopsis thaliana
  G168
atggggatgaagaaggtaaagctatctttgatagctaatgaaatatcaagggaaacatccttcatgaagaggaaaaatgggataatgaagaaactctacgagttgtcaactctatgtggtgtccaagcttgtactctcatctacagtccattcattccggttccagagtttctggagatgtcgccgacagcccgaacaaggaagatgatgaatcaagaaacgtatctaatggagaggattaccaaagcaaaagagcaactacagaacctggttggtgcgaaccaagagttacagtatcgttatgatgcaaaagaccttcaagatttgttatcttgtataaatctatatctcgatcagcttaacggaaggatcgagatccttaaagaacacggtgactcgttgccttccgtctctccttttcctactagaattggtgttgaagaaactggtgatgagtcgtcttccgactctcctattcttgctacaactggggttgtagatactcctaatgctacaaatcctcgtgttcttgtggccgatacgactcattttcttgatgcgaatgcaactgcggtaactgctccctttggattttctaatcatattcaatataagaatatgaatatgagtcaagatctgcatcgaccgtttcaacaccttgttcctactaacttttgtgatttttttcaaaatcagaatatgaatcaggttcaataccaggctcctcctaatgatatgtttaatcagattcaacgagagttctacaacattaatttgaatcagaaatcaaatcagtatatgaatcaacaacaaccattcatgaatccgatggtggaacaacatatgagtcatgttggagggcgtgagagcattcctttcatggacggaaactactacaactacaatcaactaccagtcgttgatcatggttccacaagttacatgccttccaccaccggtgtttatgatccttacttcaacaataatctctaa

SEQ ID NO: 472 - protein, 330 aa, Arabidopsis thaliana
  G168
MGMKKVKLSLIANEISRETSFMKRKNGIMKKLYELSTLCGVQACTLIYSPFIPVPEFLEMSPTARTRKMMNQETYLMERITKAKEQLQNLVGANQELQYRYDAKDLQDLLSCINLYLDQLNGRIEILKEHGDSLPSVSPFPTRIGVEETGDESSSDSPILATTGVVDTPNATNPRVLVADTTHFLDANATAVTAPFGFSNHIQYKNMNMSQDLHRPFQHLVPTNFCDFFQNQNMNQVQYQAPPNDMFNQIQREFYNINLNQKSNQYMNQQQPFMNPMVEQHMSHVGGRESIPFMDGNYYNYNQLPVVDHGSTSYMPSTTGVYDPYFNNNL

SEQ ID NO: 473 - DNA, 1458 bp, Arabidopsis thaliana
  G183
atgagtgattttgatgaaaacttcatcgaaatgacgtcgtattgggctccaccatccagtcctagcccaagaacgatattggcaatgctggagcaaaccgacaatggtctgaatccaatcagtgagatcttccctcaagaaagcttgccaagagatcatactgatcaatctggacaaagatctggtcttcgtgagagactggctgcaagagtaggattcaatcttccaacactcaatacagaagaaaacatgagtcctttggatgcatttttcaggagctcgaatgttcctaattctcctgtcgttgcaatctctccaggattcagtccatcagcactattgcatactcccaatatggtcagtgattcttcccagattatccctccgtcttcagccaccaattacggacctctagagatggtggaaacttccggtgaagacaatgcagcgatgatgatgttcaacaacgatcttccttatcagccgtacaatgttgatctgccttctctagaagtctttgatgatattgcaacggaagagtccttttatatcccatcttatgaacctcatgttgacccaattggaactcctttagtcacatcctttgaatctgaactcgttgacgatgcccataccgacatcatctccattgaggacagtgagagcgaggatggaaacaaagatgatgacgacgaggacttccaatacgaagacgaagacgaagaccaatacgaccaagatcaagatgtagatgaagatgaagaggaagaaaaagatgaagacaatgttgcattagatgatcctcaacctccacctccaaagagaaggagatatgaggtatcaaacatgattggagccacaagaacaagcaagacacaaaggatcatacttcagatggaaagcgacgaagacaatcctaacgatggttatcgctggagaaaatacggtcagaaagtcgtcaaaggaaatcctaatccgaggagttacttcaagtgcacaaacatcgagtgcagagtgaaaaaacatgtggagagaggagcagacaatatcaagttggttgtgactacatacgatgggatacacaaccatccttcaccacctgcacgtagaagcaattccagttcaaggaaccggtctgcaggggcaacaatacctcaaaatcagaatgatcgaaccagtcggttaggtagggctcctcctactcctactcctcctactcctcctccttcgtcttacacacctgaggagatgaggcctttctcttcgttggctacagaaattgatctgacagaggtttatatgaccggaatctctatgctgccgaatataccggtttacgagaattcgggttttatgtaccagaatgatgaaccgacgatgaatgcgatgccggatggttcagatgtgtacgatgggatcatggaacgcctgtattttaagtttggtgtcgacatgtag

SEQ ID NO: 474 - protein, 485 aa, Arabidopsis thaliana
  G183
MSDFDENFIEMTSYWAPPSSPSPRTILAMLEQTDNGLNPISEIFPQESLPRDHTDQSGQRSGLRERLAARVGFNLPTLNTEENMSPLDAFFRSSNVPNSPVVAISPGFSPSALLHTPNMVSDSSQIIPPSSATNYGPLEMVETSGEDNAAMMMFNNDLPYQPYNVDLPSLEVFDDIATEESFYIPSYEPHVDPIGTPLVTSFESELVDDAHTDIISIEDSESEDGNKDDDDEDFQYEDEDEDQYDQDQDVDEDEEEEKDEDNVALDDPQPPPPKRRRYEVSNMIGATRTSKTQRIILQMESDEDNPNDGYRWRKYGQKVVKGNPNPRSYFKCTNIECRVKKHVERGADNIKLVVTTYDGIHNHPSPPARRSNSSSRNRSAGATIPQNQNDRTSRLGRAPPTPTPPTPPPSSYTPEEMRPFSSLATEIDLTEVYMTGISMLPNIPVYENSGFMYQNDEPTMNAMPDGSDVYDGIMERLYFKFGVDM

SEQ ID NO: 475 - DNA, 1115 bp, Arabidopsis thaliana
  G189
ccacaactctctccttgtagagagagagattttatggcggtggagctcatgactcggaattacatctccggcgtcggagctgatagcttcgccgttcaagaagcagctgcttcaggactcaaaagtatcgaaaatttcatcggtttaatgtctcgtgatagctttaactctgatcagccatcttcttcttccgcctccgcctccgcctccgccgccgcagatcttgaatcagctcgtaacacaacggcggacgcggctgtttcaaagtttaaaagagtcatatctctcttagatcgaactcgaaccggacacgcccggtttagacgtgctccggttcatgttatttctccggttcttttacaagaagaaccaaaaacgacgccgtttcagtctcctcttcctcctccgccgcaaatgatccgaaaaggttcgttttcttcatcgatgaaaacgattgatttctcatctctctcctctgtaacaacggaatcagacaaccagaagaagattcatcatcatcaacgtccctctgaaacggcgccgtttgcgtctcaaactcaaagcctctccacgacggtctcgtctttctcaaaatcaacaaagagaaaatgtaactctgagaatcttctcaccggaaaatgcgcttccgcttcttcctccggtcgttgtcattgctcgaagaaaagaaagataaaacagaggagaataattagggttccggcgataagtgcaaaaatgtccgatgtaccaccggacgattattcatggaggaaatacggacaaaaaccaattaaaggatctccacatccaagaggatattataagtgtagtagcgtaagaggttgtccagcacgtaaacatgttgagagagcagctgatgattcgtccatgttgattgttacttatgaaggagatcataatcattctctctccgccgctgatctcgccggagccgccgttgctgatcttattttggaatcgtcttgaaaagaacaaatctttatttaaggcttttataatataaatttagatccttacttagtgaagtactcaaactatgaatgaaatcaatgtaatcaaaatcaaaaagcttttgctaaaaaaaaaaaaaaaaa

SEQ ID NO: 476 - protein, 317 aa, Arabidopsis thaliana
  G189
MAVELMTRNYISGVGADSFAVQEAAASGLKSIENFIGLMSRDSFNSDQPSSSSASASASAAADLESARNTTADAAVSKFKRVISLLDRTRTGHARFRRAPVHVISPVLLQEEPKTTPFQSPLPPPPQMIRKGSFSSSMKTIDFSSLSSVTTESDNQKKIHHHQRPSETAPFASQTQSLSTTVSSFSKSTKRKCNSENLLTGKCASASSSGRCHCSKKRKIKQRRIIRVPAISAKMSDVPPDDYSWRKYGQKPIKGSPHPRGYYKCSSVRGCPARKHVERAADDSSMLIVTYEGDHNHSLSAADLAGAAVADLILESS

SEQ ID NO: 477 - DNA, 949 bp, Arabidopsis thaliana
  G200
gagagagaaagatgggtaggcctccatgctgtgacaagatagggatcaagaaaggaccatggactcctgaagaagatatcattcttgtttcttacattcaagaacatggtcctggaaactggagatcagttcccaccaacactgggttattgagatgcagcaaaagttgtagactgagatggacaaattatctgagacctggaattaaacgtggaaactttactcctcatgaagaaggaatgatcattcacttgcaagccttattgggtaacaaatgggcgtccatagcttcatacctaccacaaagaacggacaatgatatcaagaactactggaacacacatttaaagaagaagctcaacaagtctgacagtgatgagaggagcagatcagagaacattgcgctgcaaacttcttcgacaagaaacaccattaatcatagatctacctatgcttcaagcacagaaaacatttcccgccttgtggagggttggatgagagcgtctccaaagagtagtacaagtactactttcttggaacacaaaatgcagaaccggacaaacaatttcatcgatcatcacagtgatcagtttccatacgagcagcttcaaggttctagggaagagggtcatagcaaaggaatcaacggggatgatgaccagggtataaagaattcagagaataacaacggtgatgatgttcatcatgaagatggtgatcatgaggatgatgatgatcataatgcaacaccaccattgacatttattgagaaatggcttttggaggaaacaagtactactgggggtcaaatggaagagatgagccacttgatggagctctctaatatgctttaattgtgacattttctcctttattttttctttatccttgtgaatcttataaatgagactactaattttatatacacaaataaagaaaccagaaagac

SEQ ID NO: 478 - protein, 280 aa, Arabidopsis thaliana
  G200
MGRPPCCDKIGIKKGPWTPEEDIILVSYIQEHGPGNWRSVPTNTGLLRCSKSCRLRWTNYLRPGIKRGNFTPHEEGMIIHLQALLGNKWASIASYLPQRTDNDIKNYWNTHLKKKLNKSDSDERSRSENIALQTSSTRNTINHRSTYASSTENISRLVEGWMRASPKSSTSTTFLEHKMQNRTNNFIDHHSDQFPYEQLQGSREEGHSKGINGDDDQGIKNSENNNGDDVHHEDGDHEDDDDHNATPPLTFIEKWLLEETSTTGGQMEEMSHLMELSNML

SEQ ID NO: 479 - DNA, 1139 bp, Arabidopsis thaliana
  G234
cacaacatcatacccaccaacatatataatcttgatcatagagagataaacagaggccgctatcaagaacaagactaagaacaagacttcactaggagtacaagtatgggaagagcaccgtgttgtgacaaagcaaacgtgaagaaagggccttggtctcctgaggaagatgcaaaactcaaatcttacattgaaaatagtggcaccggaggcaattggatcgctttgcctcaaaagattggtttaaagagatgtggaaagagttgcaggctgaggtggcttaactatcttagaccaaacatcaaacatggtggcttctctgaggaagaagaaaacatcatttgtagcctttaccttacaattggtagcaggtggtctataatcgctgctcaattgccgggacgaacagacaacgatataaaaaactattggaacacgaggctcaagaagaaactcattaacaaacaacgcaaggagcttcaagaagcttgtatggagcagcaagagatgatggtgatgatgaagagacaacaccaacaacaacaaatccaaacttcttttatgatgagacaagaccaaacaatgttcacatggccactacatcatcataatgttcaagttccagctcttttcagaatcaaaccaactcgttttgcgaccaagaagatgttaagccagtgctcatcaagaacatggtcaagatcgaagatcaagaactggagaaaacaaacctcatcatcatcaagattcaatgacaacgcttttgatcatctctctttctctcaactcttgttagatcctaatcataaccacttaggatcaggagagggtttctccatgaactctatcttgagcgccaacacaaactctccattgcttaacacaagtaatgataatcagtggttcgggaatttccaggccgaaaccgtaaacttgttctcaggagcctccacaagtacttcggcagatcaaagcactataagttgggaagacataagctctcttgtttattctgattcaaagcaatttttttaattataataatatattattcttaagatgaaacgtacatcattattattaattgggggtacgtaacgtatatatggaataacgatctagtttgtttaaatttaaaa

SEQ ID NO: 480 - protein, 309 aa, Arabidopsis thaliana
  G234
MGRAPCCDKANVKKGPWSPEEDAKLKSYIENSGTGGNWIALPQKIGLKRCGKSCRLRWLNYLRPNIKHGGFSEEEENIICSLYLTIGSRWSIIAAQLPGRTDNDIKNYWNTRLKKKLINKQRKELQEACMEQQEMMVMMKRQHQQQQIQTSFMMRQDQTMFTWPLHHHNVQVPALFRIKPTRFATKKMLSQCSSRTWSRSKIKNWRKQTSSSSRFNDNAFDHLSFSQLLLDPNHNHLGSGEGFSMNSILSANTNSPLLNTSNDNQWFGNFQAETVNLFSGASTSTSADQSTISWEDISSLVYSDSKQFF

SEQ ID NO: 481 - DNA, 920 bp, Arabidopsis thaliana
  G237
atggcgaagacgaaatatggagagagacataggaaagggttatggtcacctgaagaagacgagaagctaaggagcttcatcctctcttatggccattcttgctggaccactgttcccatcaaagctgggttacaaaggaatgggaagagctgcagattaagatggattaattacctaagaccagggttaaagagggatatgattagtgcagaagaagaagagactatcttgacgtttcattctcccttgggtaacaagtggtcgcaaatagctaaattcttaccgggaagaacagacaatgagataaagaactattggcactctcatttgaaaaagaaatggctcaagtctcagagcttacaagatgcaaaatctatttcccctccttcgtcttcatcatcatcacttgttgcttgtggagaaagaaatccggaaaccttgatctcgaatcacgtgttctccctccagagacttctagagaacaaatcttcatctccctcacaagaaagcaacggaaataacagccatcaatgttcttctgctcctgagattccaaggcttttcttctctgaatggctttcttcttcatatccccacaccgattattcctctgagtttaccgactctaagcacagtcaagctccaaatgtcgaagagactctctcagcttatgaagaaatgggtgatgttgatcagttccattacaacgaaatgatgatcaacaacagcaactggactcttaacgacattgtgtttggttccaaatgtaagaagcaggagcatcatatttatagagaggcttcagattgtaattcttctgctgaattcttttctccaccaacaacgacgtaaattgcgtttattgtaatgtaaatcaaatttctaaggcaaaaccggaaaaaaaaaaaaaaaaaaaaaaa

SEQ ID NO: 482 - protein, 283 aa, Arabidopsis thaliana
  G237
MAKTKYGERHRKGLWSPEEDEKLRSFILSYGHSCWTTVPIKAGLQRNGKSCRLRWINYLRPGLKRDMISAEEEETILTFHSPLGNKWSQIAKFLPGRTDNEIKNYWHSHLKKKWLKSQSLQDAKSISPPSSSSSSLVACGERNPETLISNHVFSLQRLLENKSSSPSQESNGNNSHQCSSAPEIPRLFFSEWLSSSYPHTDYSSEFTDSKHSQAPNVEETLSAYEEMGDVDQFHYNEMMINNSNWTLNDIVFGSKCKKQEHHIYREASDCNSSAEFFSPPTTT

SEQ ID NO: 483 - DNA, 2930 bp, Arabidopsis thaliana
  G275
tcaaaatcgtaaagatcagaatcaatattctcttgccacatatatcctttatagatacacctttctctcccgcatcttcaacatatatccagggccagtgcaattttctcgagaaagtgacggaaaatggctccgcagctgcaaaattgagattcggattctcccttctttcgtcactctcattcattctcgcctgtatcaggcgtacacgcgttgttatcatctgttgcttatatttgaaccatggcgcaaccaaggtacactaggatagataacaggaggccctcatcaaattattgctctacagtgacagtagttgtgtttgtggccctatgcttagtcgggatctggatgatgacatcatcttctgttggaccggctcagaatgttgatgaggtttctctggacaacaaagatgggataaagaaacagatgaccccacctgcagaggagggtaatggtcagaagtttgaagacgcacctgttgaaacaccgaacgaggataaaaaaggagatggtgatgcaagcttgcccaaagaggatgagagctcaagcaaacaagataaccaggaagagaagaaagaagagaaaactaaagaagagtttactccatccagtgagacgaaaagtgagaccgaaggtggggaagatcaaaaagatgactccaagtcagaaaatggtggtggaggtgatttagatgagaaaaaagatttgaaagacaactcagatgaagaaaatcctgacacaaatgaaaagcaaactaaaccagaaacagaggacaatgagttgggtgaggatggtgaaaaccaaaagcaatttgagtctgataacggtgagaaaaaatccattgatgatgataaaaaatccagtgatgatgataaagaaaacaagacaggcaacgaagatactgaaaccaagactgagaaggaaaacactgagacaaatgtggatgttcaagtagagcaagagggtcaatccaaaaacgagacctcaggtgatctttcacctcctggggcacaattagagctactgaatgaaactaccgcacagaatggttcattttcaacccaggcaacagagtccaaaaatgagaaagaagctcagaagggttctggtgataaacttgattacaaatgggcactatgcaatacaacagcaggacctgattacattccctgtctcgataatgtgcaagccattaggagtcttccgagtactaaacattacgagcatcgtgagaggcattgcccagacagcccacccacctgccttgttcctttgcctgatggatacaagcggccaattgagtggcccaaaagtcgagaaaagatctggtacaccaacgtccctcataccaagcttgctgagtataaggggcatcaaaattgggttaaagttaccggtgagtatctaacttttcctggtggaggaacccaattcaagcatggtgctcttcattacatcgatttcatacaggagtctgtccctgctattgcatggggtaaacgctctcgtgtggtcctggatgttggatgcggtgttgcaagctttggaggtttcctctttgacagagatgtgatcactatgtctcttgcacctaaagatgaacatgaagctcaggtgcaatttgctcttgagaggggcattcccgccatttctgcagttatgggcacgacaaggctacctttccctggcagagtttttgacatagttcattgtgctcgctgtagagtgccatggcacattgaaggtggtaaacttctcctggagcttaaccgtgtattgagacccggtgggttctttgtgtggtctgctactcctgtttatcagaagaagaccgaagatgttgaaatttggaaagctatgagtgaactcattaagaagatgtgttgggaactcgtatccattaacaaggacactatcaatggagtaggtgttgctacttacagaaagccaacttcaaatgagtgctacaaaaacagatcagaaccggtgcctccaatttgtgcagactctgatgatccaaatgcatcttggaaagtgccgcttcaagcatgcatgcacaccgcgccagaagacaaaacgcaacgtggatctcagtggcccgaacaatggccagcgagattagagaaagcaccgttctggttatcaagttcccagactggagtttacggaaaagcagcaccagaggatttcagtgctgattatgagcactggaaacgcgtagtgaccaaatcataccttaatggtttaggaatcaactgggcatctgttagaaatgtgatggacatgagagccgtttatggaggttttgcggcagctctaagagatctgaaagtgtgggtcatgaatgtggttccaatagattcaccagacacacttgcaataatctatgaacgaggactctttggtatctaccacgattggtgcgaatctttcagtacatacccgagatcatatgatctccttcacgccgaccatcttttctccaaactcaaacaaaggtgcaatctaactgcggtgatagcagaagtggatcgtgttttgagaccggaagggaaactgatagttctagacgatgcggaaacaatacagcaagtggaaggcatggtgaaagcgatgaaatgggaagttcgaatgacttattctaaggaaaaagaaggtttgctctctgttcaaaaatcaatctggcgacccagtgaagtggaaacactcacttacgctatcggttgagaagacttacttcaagtcccactcttttttgtacgtataaaaacactcttattaactccatatcatccctttttttgttggttcgtcttttaggaagttctttttttttagctgttgagtcatttgtttgtactattcgcacatttttgtgttcttgaaggtgaagaactctattgaggttctttggtaaagttaaa

SEQ ID NO: 484 - protein, 829 aa, Arabidopsis thaliana
  G275
MAQPRYTRIDNRRPSSNYCSTVTVVVFVALCLVGIWMMTSSSVGPAQNVDEVSLDNKDGIKKQMTPPAEEGNGQKFEDAPVETPNEDKKGDGDASLPKEDESSSKQDNQEEKKEEKTKEEFTPSSETKSETEGGEDQKDDSKSENGGGGDLDEKKDLKDNSDEENPDTNEKQTKPETEDNELGEDGENQKQFESDNGEKKSIDDDKKSSDDDKENKTGNEDTETKTEKENTETNVDVQVEQEGQSKNETSGDLSPPGAQLELLNETTAQNGSFSTQATESKNEKEAQKGSGDKLDYKWALCNTTAGPDYIPCLDNVQAIRSLPSTKHYEHRERHCPDSPPTCLVPLPDGYKRPIEWPKSREKIWYTNVPHTKLAEYKGHQNWVKVTGEYLTFPGGGTQFKHGALHYIDFIQESVPAIAWGKRSRVVLDVGCGVASFGGFLFDRDVITMSLAPKDEHEAQVQFALERGIPAISAVMGTTRLPFPGRVFDIVHCARCRVPWHIEGGKLLLELNRVLRPGGFFVWSATPVYQKKTEDVEIWKAMSELIKKMCWELVSINKDTINGVGVATYRKPTSNECYKNRSEPVPPICADSDDPNASWKVPLQACMHTAPEDKTQRGSQWPEQWPARLEKAPFWLSSSQTGVYGKAAPEDFSADYEHWKRVVTKSYLNGLGINWASVRNVMDMRAVYGGFAAALRDLKVWVMNVVPIDSPDTLAIIYERGLFGIYHDWCESFSTYPRSYDLLHADHLFSKLKQRCNLTAVIAEVDRVLRPEGKLIVLDDAETIQQVEGMVKAMKWEVRMTYSKEKEGLLSVQKSIWRPSEVETLTYAIG

SEQ ID NO: 485 - DNA, 1558 bp, Arabidopsis thaliana
  G326
caattaatgacatcttcttcttctcctttcactgcaaaaccgaaagcttgagactttgagattatgtctatgtcatcttcttcttcttccatcgatcacttcatcacctttcgtcatcttgatcttattctccactgtataaaatcagcgagattttaagggattgtgaaggtaccatcttaaacacaaaatgggtacttctactacagagagtgtggtggcgtgtgaattttgcggcgagagaacggcggttctgttttgtagagccgatacggcgaagctttgtttgccttgtgaccagcacgtgcactcggcgaaccttctctcgaggaagcatgttcgttctcagatctgtgataactgtagcaaagagccggtgtccgtacgttgcttcacagataatctcgtattgtgtcaggagtgtgattgggatgttcacggaagctgttcctcctccgcgacgcatgaacgctccgccgtggaagggttttcaggttgtccttcggttttggagcttgctgctgtgtggggaatcgatttaaagggtaagaagaaagaagatgacgaagacgaattgactaagaattttgggatggggttggattcgtggggttctggatctaacatcgttcaagaactgattgttccttatgatgtgtcttgcaaaaagcaaagctttagctttgggaggtctaagcaggtagtgtttgaacagcttgagttactgaagagaggcttcgttgaaggcgaaggagagattatggttccggagggaatcaatggcggaggaagcatttctcagccatctccgacgacgtcgtttacttctttgcttatgtctcaaagtctttgtggtaatggtatgcaatggaatgctactaatcatagcactggccagaacactcagatatgggattttaacttgggacagtcgaggaaccctgatgaacctagtccagtcgaaactaaaggctctactttcacattcaacaacgttactcatctcaagaacgatacccgaaccaccaatatgaatgctttcaaagagagttaccaggaggattccgtccactcaacttctaccaagggacaggaaacatctaagagcaacaatattcctgctgccattcactcgcataaaagttctaacgactcctgtggcttgcattgcacggaacatattgctattactagtaatagagccacaagattggtggcggtaacgaatgctgatctagagcagatggcacagaacagagataatgctatgcagcggtacaaggaaaagaagaaaacgcggagatatgataagaccataagatatgaaacgaggaaggcgagagccgagaccaggttgcgtgttaagggcagatttgtgaaagctacagatccttagatgtctctccacgttaggttttacatttgagatcctaagttaggaactttttttgttttttctactttcaactaccttgtaaatgtaaatgatcgatcttcagctgcataatgtgtggccagatttttgtaatttttacgtttaaccttctaaaaaaaaaaa

SEQ ID NO: 486 - protein, 401 aa, Arabidopsis thaliana
  G326
MGTSTTESVVACEFCGERTAVLFCRADTAKLCLPCDQHVHSANLLSRKHVRSQICDNCSKEPVSVRCFTDNLVLCQECDWDVHGSCSSSATHERSAVEGFSGCPSVLELAAVWGIDLKGKKKEDDEDELTKNFGMGLDSWGSGSNIVQELIVPYDVSCKKQSFSFGRSKQVVFEQLELLKRGFVEGEGEIMVPEGINGGGSISQPSPTTSFTSLLMSQSLCGNGMQWNATNHSTGQNTQIWDFNLGQSRNPDEPSPVETKGSTFTFNNVTHLKNDTRTTNMNAFKESYQEDSVHSTSTKGQETSKSNNIPAAIHSHKSSNDSCGLHCTEHIAITSNRATRLVAVTNADLEQMAQNRDNAMQRYKEKKKTRRYDKTIRYETRKARAETRLRVKGRFVKATDP

SEQ ID NO: 487 - DNA, 570 bp, Arabidopsis thaliana
  G347
atgaaagtagcagatatgcaggaccagctggtgtgtcatggttgtaggaatttattgatgtatcctagaggagcatctaatgtgcgttgtgcgttatgtaacactatcaacatggttcctcctcctcctccacctcacgacatggcacacattatatgtggtggttgtagaacaatgcttatgtatacgcgtggggctagtagcgtaagatgctcttgctgtcaaactacgaaccttgtgccagcgcactccaatcaggttgcccatgctccttccagtcaggttgcgcagatcaattgtgggcattgtcggacgaccctcatgtatccttacggtgcatcatccgtcaaatgcgctgtttgtcaattcgtaactaacgttaatatgagcaatggaagggtacctctcccaactaaccggccaaatggaacagcttgtcccccctctacatcaacttcaacaccaccctctcagacccaaaccgttgttgtagaaaaccccatgtccgttgatgaaagcggaaagttggtgagcaatgttgttgttggagtgacaactgacaaaaagtaa

SEQ ID NO: 488 - protein, 189 aa, Arabidopsis thaliana
  G347
MKVADMQDQLVCHGCRNLLMYPRGASNVRCALCNTINMVPPPPPPHDMAHIICGGCRTMLMYTRGASSVRCSCCQTTNLVPAHSNQVAHAPSSQVAQINCGHCRTTLMYPYGASSVKCAVCQFVTNVNMSNGRVPLPTNRPNGTACPPSTSTSTPPSQTQTVVVENPMSVDESGKLVSNVVVGVTTDKK

SEQ ID NO: 489 - DNA, 1501 bp, Arabidopsis thaliana
  G427
tttccctctccgaaacagaaattcaaaaacaaattcaacacgaaaacgatggcgtttcataacaatcactttaatcatttcaccgaccaacaacaacatcagcctcctcctccgccgcaacagcagcagcaacaacattttcaagaatcagcaccccctaattggctcctccgctccgacaacaacttcctcaatctccacacagctgccacagccgccgctacaagctccgattctccttcttccgccgccgctaaccagtggctctcacgatcctcatccttcctccaacgaggcaacaccgcaaacaacaacaacaacgaaacatccggtgacgtcatcgaagacgttcccggcggagaggagtcaatgatcggagagaagaaggaggcggagaggtggcagaatgcgagacacaaggcggagatactgtctcatccactatacgagcaacttttgtcggcacacgtggcgtgcctgaggatcgcaacgccggtggatcagcttccgaggatagacgcacagcttgctcagtctcaaaacgtcgtggctaagtactcaactttagaagccgctcaaggactcctcgccggcgatgacaaggagcttgaccacttcatgacgcattatgtactattgctttgctctttcaaagaacaactgcaacagcatgttcgtgttcatgcaatggaagctgttatggcctgttgggagattgaacagtcgcttcaaagttttacaggagtatctcctggtgaaggcacaggagcaacaatgtctgaggatgaagatgagcaagtagagagtgatgctcatttgtttgatggaagcttagatgggttagggtttggtcctctagttcccactgagagcgagagatctttgatggaacgagtcagacaagaactcaaacatgaactcaagcagggttacaaggagaaaattgtggacataagagaggagatactgaggaagagaagagctggaaaattaccaggagacaccacctctgttctcaaatcatggtggcaatctcattctaagtggccttaccctactgaggaagataaggcgaggttggtgcaggagacgggtttgcagctcaaacagataaacaattggttcatcaatcaaagaaagaggaattggcatagcaatccatcttcttctaccgtctcaaagaataaacgccgaagcaatgcaggtgaaaacagcggaagagaccgttgagatcaagcttgcatgtagagatccaaaagctttatagaaaggtggaggcatgaagacaaagaattcttacacaacaaacgtaggacgtaattttgtgccagtacatggtatggctttcatatttggtaatgattagggccacacaaaattaaaccccaaagcatgatttgtaatatgaggttttagatggactttatgataggatcgtcagtcttcactgccatctccattctccaccatcaatccatcattatatcttgtgaaaaaaaaa

SEQ ID NO: 490 - protein, 393 aa, Arabidopsis thaliana
  G427
MAFHNNHFNHFTDQQQHQPPPPPQQQQQQHFQESAPPNWLLRSDNNFLNLHTAATAAATSSDSPSSAAANQWLSRSSSFLQRGNTANNNNNETSGDVIEDVPGGEESMIGEKKEAERWQNARHKAEILSHPLYEQLLSAHVACLRIATPVDQLPRIDAQLAQSQNVVAKYSTLEAAQGLLAGDDKELDHFMTHYVLLLCSFKEQLQQHVRVHAMEAVMACWEIEQSLQSFTGVSPGEGTGATMSEDEDEQVESDAHLFDGSLDGLGFGPLVPTESERSLMERVRQELKHELKQGYKEKIVDIREEILRKRRAGKLPGDTTSVLKSWWQSHSKWPYPTEEDKARLVQETGLQLKQINNWFINQRKRNWHSNPSSSTVSKNKRRSNAGENSGRDR

SEQ ID NO: 491 - DNA, 1128 bp, Arabidopsis thaliana
  G505
atggacattccgtattaccactacgaccatggcggagacagccaatatcttccaccgggtttcaggtttcatcccacggacgaagagctcatcactcattaccttctccgcaaagtcctcgacggttgcttctcaagccgtgccatcgcagaagttgatctcaacaagtgtgagccttggcaacttcccgggagagctaagatgggagagaaagaatggtacttctttagcctccgtgaccggaagtatccgacgggactgagaactaacagagcaactgaggctggttactggaaagctaccggaaaagacagagagatctttagttcaaagacttgtgcacttgttgggatgaagaagactcttgtcttttacaaaggaagagctccgaaaggagagaagagtaattgggttatgcatgaatatcgtcttgaaggcaaattctcttaccatttcatctcaagaagctccaaggatgaatgggtgatctctagggttttccagaaaaccactttagctagcaccggagccgtctccgaaggaggaggaggaggaggagcaactgtgagcgtaagcagcggtactggtccatctaaaaagacgaaagtaccctcaacaatctcaagaaactatcaagaacaaccaagctctccttcctccgtctcactcccacctctcctggatccgaccactaccctcggctacaccgacagcagttgctcctacgacagccgtagcaccaacacaaccgtcacagccagcgcaataaccgagcacgtgtcctgtttctccactgtccctactactactacggccttgggcttagacgttaactcattcagccgtcttccaccgccgctagggtttgactttgacccttttcctcgtttcgtttctagaaacgtctcgactcaatctaacttcagatcgttccaagaaaacttcaatcaatttccttactttggatcgtcttctgcatcgactatgacctccgccgttaatctgccttctttccaaggcggcggaggcgtctccgggatgaattactggctaccggcgactgccgaagagaatgagtcaaaggtcggtgtgcttcatgctggacttgactgtatttggaactactga

SEQ ID NO: 492 - protein, 375 aa, Arabidopsis thaliana [sequence omitted]

SEQ ID NO: 493 - DNA, 1292 bp, Arabidopsis thaliana
  G590
tcgacagacactctccctctctccatgcccataaaatctcaaagactgtttaaaaaaaaaaatgttttagctttaactgctttttttttgttgttggtgtaatgatatcacagagagaagaaagagaagagaagaagcagagagtgatgggagataagaaattgatttcatcttcttcttcttcctcggtttacgatactcgtatcaatcatcatcttcatcatcctccgtcttcttccgacgaaatctctcagtttctccggcatattttcgaccgttcttctcctttaccttcttactactccccggcgacgactacaacgacggcgtctttgattggtgtgcacgggagcggtgacccacatgcagataactcgagaagtctcgtttctcatcatccaccgtcagattctgtgcttatgtcgaaacgtgtcggagatttctctgaggttttaatcggcggaggatcaggctcagccgccgcgtgttttggtttctccggtggtggtaataataacaacgttcaaggaaatagctctgggactcgagtatcgtcttcttccgttggagctagtggcaacgagacagatgagtatgactgtgaaagcgaggaaggaggagaagctgtagttgatgaagctccctcttccaagtcaggtccttcttctcgtagttcatctaaaagatgcagagctgctgaagttcataatctctctgagaagaggaggagaagtagaattaatgaaaaaatgaaagctttacaaagtctcatccctaattcaaataagacggataaggcttcaatgcttgatgaagccattgagtatctgaaacagcttcagctccaagttcagatgttgactatgagaaatggaataaacttgcatcctttgtgtttacctggaactacattacacccattgcaactctctcagattcgaccccctgaagcaaccaatgatcctctgcttaatcataccaatcagtttgcttcgacttctaatgcaccggaaatgatcaatactgtggcttcttcatacgctttggaaccttctattcgcagtcactttggacctttccctctccttacttcacccgtggagatgagtcgggaaggtgggttaactcatccaaggttgaacattggtcattccaacgcaaacataaccggggaacaagctctgtttgatggacaacctgacctaaaagatcgaattacttgaacagtgtcccaacttcgggatctctatgtgttcttgtttcttagaacgcaagccataaagctgtctgac

SEQ ID NO: 494 - protein, 373 aa, Arabidopsis thaliana
  G590
MISQREEREEKKQRVMGDKKLISSSSSSSVYDTRINHHLHHPPSSSDEISQFLRHIFDRSSPLPSYYSPATTTTTASLIGVHGSGDPHADNSRSLVSHHPPSDSVLMSKRVGDFSEVLIGGGSGSAAACFGFSGGGNNNNVQGNSSGTRVSSSSVGASGNETDEYDCESEEGGEAVVDEAPSSKSGPSSRSSSKRCRAAEVHNLSEKRRRSRINEKMKALQSLIPNSNKTDKASMLDEAIEYLKQLQLQVQMLTMRNGINLHPLCLPGTTLHPLQLSQIRPPEATNDPLLNHTNQFASTSNAPEMINTVASSYALEPSIRSHFGPFPLLTSPVEMSREGGLTHPRLNIGHSNANITGEQALFDGQPDLKDRIT

SEQ ID NO: 495 - DNA, 720 bp, Arabidopsis thaliana
  G602
ataaaatctgttcttcttcttcggctgagagacaatggcggaggagcaaaagacgagtaaggttgacgtagaatctccggctgttttagctccggcgaaggaaccgactcctgctccggtggaagtcgcggatgagaaaattcataatccacctcccgtcgagtccaaagctcttgccgttgtagaaaaacccatcgaggagcatacacctaagaaagcttcatctggttcggccgatagagatgtgatacttgccgacttggaaaaagagaagaaaacgtcattcatcaaagcatgggaagagagtgagaagtcaaaggctgagaacagggcacaaaagaagatctctgatgtgcatgcttgggaaaatagcaagaaagcagccgtagaagctcaacttaggaagatcgaggaaaaattagagaagaaaaaagcgcagtacggtgagaaaatgaagaacaaagtagctgcaatccacaagttagcagaagagaagagagcaatggttgaagctaaaaaaggagaagagcttctcaaagctgaagaaatgggtgctaagtatagagccactggtgtagtaccaaaggcaacgtgtggatgtttctaagcctttattgaatttgtatctttgtaacaattcatctctgtttctttcttcttcttttgtttttgtgtgattcaacaactctttttagtttttgttatttgtttggaaaaaaa

SEQ ID NO: 496 - protein, 190 aa, Arabidopsis thaliana
  G602
MAEEQKTSKVDVESPAVLAPAKEPTPAPVEVADEKIHNPPPVESKALAVVEKPIEEHTPKKASSGSADRDVILADLEKEKKTSFIKAWEESEKSKAENRAQKKISDVHAWENSKKAAVEAQLRKIEEKLEKKKAQYGEKMKNKVAAIHKLAEEKRAMVEAKKGEELLKAEEMGAKYRATGVVPKATCGCF

SEQ ID NO: 497 - DNA, 1564 bp, Arabidopsis thaliana
  G618
cagataacgaccatttcttagattctccgtcgccgcctcttctagagatgagacaccaccaatcagcgacggagaacggtggtggttgcggagagattgtggaggtacaaggaggtcacattgttcggtcaacaggaagaaaagacagacatagtaaagtatgtacagcgaaaggaccacgtgaccggcgcgtgagactctcagctccgacggcgattcaattctacgatgttcaagatagacttggttttgatcgaccaagtaaagctgttgattggcttattactaaagctaaatccgccattgatgatcttgctcagcttcctccttggaaccccgccgatactcttcgtcaacacgccgccgctgctgctaacgctaaacccagaaaaaccaaaactttaatttctccgccaccgccacaaccggaagaaacagagcatcatcgaatcggagaagaagaagataacgaatcgagttttcttccggcgtcaatggattctgattcgatagctgacactataaagtcgttttttccggtagcttcaacgcaacagagctatcatcatcagccaccgtcacgaggcaatacacagaaccaagatcttcttcgtctctcgcttcaatctttccaaaatggtccaccttttcctaatcaaacagaacctgctctgttctccggccagagcaataatcagttagcgtttgactcatcgacggcaagctgggaacagagtcatcagtcaccggaatttggaaagatacagagactagtgtcatggaacaacgtcggagcagctgaatccgccggaagtaccggaggatttgtgtttgcttctccgtcgtcgttgcatccagtttatagccaaagtcagcttttatcacagaggggtccccttcagtccattaacacacctatgattcgtgcttggtttgatcctcaccatcatcatcatcatcatcagcagtccatgaccactgacgatctccaccatcatcatccctaccatatccctcccgggattcaccaatctgctattccaggcattgcatttgcttcaagtggtgaattctccggttttcgtataccagcacggtttcaaggcgaacaagaggagcacggcggcgacaacaagccgtcctctgcttcatccgattctcgccattaaacaagttccaaaaacacataagattgtgcaacacaacaggtttcttttcatattccagggcgcttcgaatgcgtggaatagtgaaggcggttttcgttgttgtgtgtttcgaatatccaaatggcctataaatctgatcaacagtttcaggttcttcttaagtctttaaaagcctaggccttggttaatttgaattcatcttgtatcaattagagaacgttctgtaagttcaattctgttttacaatgtttagctctagctacatgagctcacatcttgtttgttgtaacttgttctacaattacttgtcgtttctttatgttcttgtgttggaaacctttaaccccacttgaagctaaagtcttttgtttgccctttaaaaaaaaaaaaaaaaa

SEQ ID NO: 498 - protein, 373 aa, Arabidopsis thaliana
  G618
MRHHQSATENGGGCGEIVEVQGGHIVRSTGRKDRHSKVCTAKGPRDRRVRLSAPTAIQFYDVQDRLGFDRPSKAVDWLITKAKSAIDDLAQLPPWNPADTLRQHAAAAANAKPRKTKTLISPPPPQPEETEHHRIGEEEDNESSFLPASMDSDSIADTIKSFFPVASTQQSYHHQPPSRGNTQNQDLLRLSLQSFQNGPPFPNQTEPALFSGQSNNQLAFDSSTASWEQSHQSPEFGKIQRLVSWNNVGAAESAGSTGGFVFASPSSLHPVYSQSQLLSQRGPLQSINTPMIRAWFDPHHHHHHHQQSMTTDDLHHHHPYHIPPGIHQSAIPGIAFASSGEFSGFRIPARFQGEQEEHGGDNKPSSASSDSRH

SEQ ID NO: 499 - DNA, 993 bp, Arabidopsis thaliana
  G635
atggagatcatgcgtccaggggtctcagaaaacactttgaaaggaaaaataagaatcacaacgcggtgcatgtggcttgacaaaggaagacttttagatgcacttcacaaagcagctcatgctgctctatcaagttgtcctgtgacatgtcccttgtctcacatggaaagaacagtctccgaagtcctgaggaagattgtaaggaagtacagtggtaaaaggcctgaagtcatcgctatagccactgagaatccaatggctgtccgagctgatgaggtcagtgcgagactgtctggtgatccaagtgttggttctggagttgcagctttaaggaaagttgttgaaggaaatgacaaaagaagtcgggcgaagaaagcaccttcacaagaagcttcccccaaagaagtagatcgcactttggaagatgatatcattgatagtgcaagactactggctgaagaagaaactgcggcatcaacatacacggaagaagttgatacgcccgttgggagttcttcagaagagtcagacgatttttggaaatcattcatcaatccatcatcgtcaccttcaccgagtgaaacagaaaatatgaataaggtagctgatacggagcctaaagcagagggtaaggaaaacagcagagacgacgatgaattagctgatgcttcagattctgaaaccaagtcatcaccaaaacgtgtgaggaagaacaaatggaaaccggaggagataaagaaggtaatcagaatgcgaggagagctgcacagtagatttcaagtggtgaaaggtagaatggcattgtgggaagagatctcttcaaatctatcagctgaaggaatcaatcgaagcccgggacaatgcaaatctctctgggcatcacttattcagaaatacgaggagagcaaggctgatgagagaagcaagacgagttggccacattttgaggatatgaacaacattttgtcagagctaggcacacctgcgtcttaa

SEQ ID NO: 500 - protein, 330 aa, Arabidopsis thaliana
  G635
MEIMRPGVSENTLKGKIRITTRCMWLDKGRLLDALHKAAHAALSSCPVTCPLSHMERTVSEVLRKIVRKYSGKRPEVIAIATENPMAVRADEVSARLSGDPSVGSGVAALRKVVEGNDKRSRAKKAPSQEASPKEVDRTLEDDIIDSARLLAEEETAASTYTEEVDTPVGSSSEESDDFWKSFINPSSSPSPSETENMNKVADTEPKAEGKENSRDDDELADASDSETKSSPKRVRKNKWKPEEIKKVIRMRGELHSRFQVVKGRMALWEEISSNLSAEGINRSPGQCKSLWASLIQKYEESKADERSKTSWPHFEDMNNILSELGTPAS

SEQ ID NO: 501 - DNA, 885 bp, Arabidopsis thaliana
  G643
atggaggaaggaacttcaggttcacggagaacacggtctcaagttgctccagaatgggcagtcaaagattgtctagtcctcgtgaatgagatcgctgcggttgaagccgattgttcgaatgctttatctagcttccagaaatggacaatgatcacagagaactgcaacgctttggatgttagcagaaatctaaaccaatgcaggaggaaatgggattctttgatgtctgattacaatcagatcaagaagtgggaatctcagtaccgaggcactggtcgttcctattggtccctgagtagtgacaagaggaagttacttaatctcccgggggatatcgatatcgagctttttgaagccatcaatgcggttgtgatgatccaagatgaaaaagctgggactgaatctgatagtgaccctgaagcgcaagacgttgttgatctctctgctgaattagcttttgtaggatcaaaaagatcaagacagcgaacaatggtcatgaaggagacaaagaaagaagagccacggactagccgagttcaagtaaacactcgagagaaacctataactacaaaagcaacccatcagaacaaaaccatgggagagaagaagccggtggaagatatgtccacagatgaagaagaagatgaaacaatgaacatagaagaggatgtagaagtgatggaagcgaagctaagttataaaattgacttgatacatgcgatagtcgggagaaatctagcaaaggataatgaaacaaaggatggtgttagtatggacgacaagttgaagtctgtgagacagcaaggagacgagctcatcggttgtctgagtgaaattgttagtacccttaataggcttcatgaagttccacaagaaatcgagtga

SEQ ID NO: 502 - protein, 294 aa, Arabidopsis thaliana
  G643
MEEGTSGSRRTRSQVAPEWAVKDCLVLVNEIAAVEADCSNALSSFQKWTMITENCNALDVSRNLNQCRRKWDSLMSDYNQIKKWESQYRGTGRSYWSLSSDKRKLLNLPGDIDIELFEAINAVVMIQDEKAGTESDSDPEAQDVVDLSAELAFVGSKRSRQRTMVMKETKKEEPRTSRVQVNTREKPITTKATHQNKTMGEKKPVEDMSTDEEEDETMNIEEDVEVMEAKLSYKIDLIHAIVGRNLAKDNETKDGVSMDDKLKSVRQQGDELIGCLSEIVSTLNRLHEVPQEIE

SEQ ID NO: 503 - DNA, 928 bp, Arabidopsis thaliana
  G653
tcttcatcttcatcttcacgcagcgacttctttgattctctctttttattctcagctccaatttcaacctgcatttctctcttctcaattttgggtttctttttttgatatctcatttgatcagatcgacgaagagaggaagaaggtttgagctgagagatctttggaggtagaaagaagatctcaaaaacgatgtcgtttacaggaactcagcagaaatgcagggcgtgcgagaagacagtgtaccctgtggagcttctctcagctgatggaatctcttatcacaaggcttgcttcaaatgctctcactgcaaaagcagacttcaactgagcaattattcatcaatggaaggagtggtgtattgtaggcctcattttgagcagcttttcaaggagtctggtagtttcagcaagaactttcagtcacctgcaaagccattgactgataagccaaccccggagctgaataggacacctagtcgacttgctggtatgttctctggaacgcaagacaaatgcgctacttgcactaaaaccgtgtatcctatcgaaaaggtaactgtggaaagccagtgttaccataaatcttgcttcaagtgttctcatggaggctgtccgatatctccatcgaactatgcagctctagagggaatattgtactgcaagcaccatttcgctcagcttttcaaggagaaaggaagttacaatcatctcatcaaatctgcttccatcaaacgtgctactgctgctgctaccgcagctgctgcagctgtagcagccgttcccgaatcttgaattcaaattctctttatttttgtgtatgtgctgtgttgtttacatgtattcgatatgattcatgttctttgtcttccataattgaaccaggcataaaattctcccagttttctctgaaaaaaaaaaaaaaaaa

SEQ ID NO: 504 - protein, 200 aa, Arabidopsis thaliana
  G653
MSFTGTQQKCRACEKTVYPVELLSADGISYHKACFKCSHCKSRLQLSNYSSMEGVVYCRPHFEQLFKESGSFSKNFQSPAKPLTDKPTPELNRTPSRLAGMFSGTQDKCATCTKTVYPIEKVTVESQCYHKSCFKCSHGGCPISPSNYAALEGILYCKHHFAQLFKEKGSYNHLIKSASIKRATAAATAAAAAVAAVPES

SEQ ID NO: 505 - DNA, 2331 bp, Arabidopsis thaliana
  G657
atgaagcgtgagatgaaagcacctactactccactagagagtctccaaggtgacctcaaaggaaaacaagggaggacatctggccctgctagacgatctaccaaaggacaatggacacctgaagaggacgaagtcttgtgtaaagctgttgagcgttttcaaggaaagaactggaagaagatagctgaatgttttaaggatcggactgatgttcagtgtcttcatagatggcaaaaggtcttgaacccagagcttgtgaaaggaccgtggtcaaaagaggaggataacacaataattgacctggttgaaaaatatgggccaaagaaatggtctactatatctcagcatttacctgggcgcataggaaagcaatgtagggaaaggtggcataaccatcttaaccctgggattaataaaaatgcatggactcaggaagaggaactgactcttattcgtgcgcatcaaatttatgggaataaatgggcagagcttatgaaatttttgccaggaaggtcagataattcgataaaaaatcattggaacagctcagttaagaagaagttggattcctactatgcatcaggtcttttagatcagtgtcaaagctcgccattaattgcccttcagaacaaatctatcgcttcatcttcctcgtggatgcacagcaatggagatgaaggtagttcaaggccaggggttgatgctgaggaatcagaatgcagccaagcttcaactgttttctcacaatcaaccaacgatttacaagatgaagttcaacgtggaaatgaggaatattacatgcctgaatttcattcaggaacggagcagcaaatctcaaacgctgcatctcatgcagaaccgtactacccttcctttaaagatgtcaaaattgttgtccccgaaatttcttgtgaaacagaatgttcgaagaagtttcagaatcttaattgttctcacgagctaagaactaccacagctacggaggatcaattgccgggtgtatctaatgatgctaaacaggaccgtggtctagagttattgacccataacatggacaacggtggaaaaaaccaagcacttcaacaagattttcaaagttcagtaagattaagtgatcaaccttttttgtcaaactcggacacagatccagaagctcaaactttgatcacggatgaggagtgttgtagggttctttttccagataacatgaaagatagcagtacatcttctggtgagcaaggtcggaatatggttgaccctcaaaacggcaaaggatctctttgttctcaggctgcagaaacccatgctcatgaaactggaaaagttccagctttaccgtggcatccttcaagttctgagggcctggcgggtcataattgtgtccctttgttggattcagacttgaaggactcacttttaccccgtaatgattccaacgctcctatacaaggttgtcgcctttttggagctaccgaattagaatgtaagactgatacaaatgacggtttcatcgatacttacggacatgtaacttcccatggcaatgatgataatggtggtttcccagaacaacaggggctgtcatatattcccaaggattctttgaagctagtacctttgaatagtttttcttctccttctagagtgaacaagatttattttcctattgacgataagccggctgaaaaagacaaaggagctctttgttatgaacctccacgttttccaagtgcagatattcctttcttcagctgtgatcttgtaccatcaaatagtgacttacggcaagagtacagtccctttggtatccgtcagttgatgatttcttcaatgaattgtacaactccgttaaggttatgggattcaccgtgtcacgataggagccctgatgtcatgcttaatgatactgccaaaagttttagtggtgcaccatccatcttaaagaagcggcatcgagacttgctttcacctgtgcttgatagaagaaaagacaaaaagcttaaaagggctgcgacttcctccttggctaatgatttttcgcgcttagatgtaatgcttgatgaaggagatgattgcatgacctctcgtccgtcagagtctcctgaagataaaaatatatgtgcctccccttccatagccagagataacagaaattgtgcatcagctcggttatatcaagaaatgattccgatagatgaggaaccaaaggaaaccttagaatcaggtggagtgacttctatgcaaaatgaaaatggatgtaatgacggtggtgcttcagctaaaaatgtaagtccgtctttgtccttgcatattatctggtatcagttataa

SEQ ID NO: 506 - protein, 776 aa, Arabidopsis thaliana
  G657
MKREMKAPTTPLESLQGDLKGKQGRTSGPARRSTKGQWTPEEDEVLCKAVERFQGKNWKKIAECFKDRTDVQCLHRWQKVLNPELVKGPWSKEEDNTIIDLVEKYGPKKWSTISQHLPGRIGKQCRERWHNHLNPGINKNAWTQEEELTLIRAHQIYGNKWAELMKFLPGRSDNSIKNHWNSSVKKKLDSYYASGLLDQCQSSPLIALQNKSIASSSSWMHSNGDEGSSRPGVDAEESECSQASTVFSQSTNDLQDEVQRGNEEYYMPEFHSGTEQQISNAASHAEPYYPSFKDVKIVVPEISCETECSKKFQNLNCSHELRTTTATEDQLPGVSNDAKQDRGLELLTHNMDNGGKNQALQQDFQSSVRLSDQPFLSNSDTDPEAQTLITDEECCRVLFPDNMKDSSTSSGEQGRNMVDPQNGKGSLCSQAAETHAHETGKVPALPWHPSSSEGLAGHNCVPLLDSDLKDSLLPRNDSNAPIQGCRLFGATELECKTDTNDGFIDTYGHVTSHGNDDNGGFPEQQGLSYIPKDSLKLVPLNSFSSPSRVNKIYFPIDDKPAEKDKGALCYEPPRFPSADIPFFSCDLVPSNSDLRQEYSPFGIRQLMISSMNCTTPLRLWDSPCHDRSPDVMLNDTAKSFSGAPSILKKRHRDLLSPVLDRRKDKKLKRAATSSLANDFSRLDVMLDEGDDCMTSRPSESPEDKNICASPSIARDNRNCASARLYQEMIPIDEEPKETLESGGVTSMQNENGCNDGGASAKNVSPSLSLHIIWYQL

SEQ ID NO: 507 - DNA, 2579 bp, Arabidopsis thaliana
  G837
ggttctttctactagatccggatctggaactttctctactctctgctcataaagtttcattctttggggagatctgaggcaaccctttttctctggtgcatgtgactagggattgtgccgtgggtttaggatcatggcaatggggaagtattctcgtgtagacgggaagaagtcatcgggatatggcttaaccattaccatcgttttaattgtttctctatgtttggttggggcgtggatgttcatgtcttcatggtctgctccaactgagtctattgacttctctgcaaacgagaggacaaaagatgtagatactactaagagtgatttcaaaagtgaagaggttgatcgaggttccaagagttttccggatgaaaagaatgaggagacggaggttgtgacagagaccaacgaagagaagactgatcctgagaaatctggtgaggagaactctggtgagaaaacggagtcggctgaggaaagaaaggagtttgatgacaaaaatggtgatggggatagaaaaaatggagacggtgagaaagacacggaatcagaaagtgatgaaaccaagcaaaaagagaaaacacaactggaagagagctcagaagaaaacaaatctgaggatagtaatggaaccgaagagaatgctggtgaatctgaagaaaacaccgagaagaagtcagaagaaaacgctggtgaaactgaagagagcactgagaagagtaaggatgttttcccagctggtgaccaggctgaaatcacaaaggagtcaagcactggaagtggggcttggtctacccaattggtggaatcccagaacgagaagaaagcacaagtgtcctcaattaaatggaaagtctgcaatgtgacagctggaccagactacatcccttgccttgacaattggcaagctatcagaaagcttcattcgacaaagcattatgaacatcgtgagaggcattgtcccgaggagtctccacgctgccttgtttctcttcccgaagggtataagcgatccatcaagtggcctaagagcagagaaaagatctggtacaccaatattccacacaccaagcttgcagaagtcaagggacatcaaaactgggtgaagatgagtggtgaatacttaacattccctggtggaggtactcaattcaagaatggtgctcttcactacattgatttcctccaagagtcatatcctgatattgcttggggaaataggactcgtgttatattggatgttgggtgtggggttgctagctttgggggatatctttttgacagagatgtactcgctttgtcatttgcacccaaagacgaacacgaggcacaggtgcaatttgctctggaacgtggtattcctgcaatgtcaaatgttatgggaaccaagagattaccttttccaggatctgtttttgaccttatccattgtgctcgttgtagagttccttggcatatcgaaggtggtaaactacttttggagttgaaccgtgcattgaggccgggtggtttctttgtctggtcagcgactccagtctataggaagactgaggaagatgttggcatatggaaagctatgtcgaagctaacaaaggcaatgtgctgggaactgatgacgattaagaaagatgaactgaatgaagttggtgctgccatttaccagaagccaatgtcgaataaatgctacaatgaaagatctcaaaatgagccacctctctgcaaagactctgatgatcaaaatgccgcctggaatgttccacttgaggcatgtattcacaaagtaacagaagattcatcaaaacgcggagcagtttggcctgaaagttggccggaaagagtggagacggttcctcagtggttagattctcaggaaggagtatatggaaaacctgcacaagaggatttcacagcagaccatgaacgctggaagactattgtttcaaagtcatacctcaacggtatgggaatcgattggtcttatgttagaaatgtgatggacatgagagcagtctatggaggttttgctgctgcattgaaggatctgaaactgtgggtgatgaatgtagttcctatcgactcacctgatacccttccgattatatacgaacgtggtttgtttggaatctatcatgattggtgtgaatcattcagcacttaccctcggacttacgacctccttcacgctgatcatcttttctcttcactgaaaaagaggtgcaacttggtgggcgtgatggctgaagtagaccggattcttagaccacaaggaactttcatagtaagagatgacatggaaacgataggagaaattgagaagatggtgaaatcgatgaaatggaatgtaagaatgacacattccaaagatggagaaggattgctctctgttcagaagtcatggtggcgtcctacagaggccgagaccattcagtcggcaatagcttgagatcaaggaaacgaagaagagtgtgggttaatatagtcgacagttgttccttttacgatccaattgattgtttcttacatgtattagtcgaatatttgtatcccttttttgcattgaagaaagttgtatacaa

SEQ ID NO: 508 - protein, 770 aa, Arabidopsis thaliana
  G837
MAMGKYSRVDGKKSSGYGLTITIVLIVSLCLVGAWMFMSSWSAPTESIDFSANERTKDVDTTKSDFKSEEVDRGSKSFPDEKNEETEVVTETNEEKTDPEKSGEENSGEKTESAEERKEFDDKNGDGDRKNGDGEKDTESESDETKQKEKTQLEESSEENKSEDSNGTEENAGESEENTEKKSEENAGETEESTEKSKDVFPAGDQAEITKESSTGSGAWSTQLVESQNEKKAQVSSIKWKVCNVTAGPDYIPCLDNWQAIRKLHSTKHYEHRERHCPEESPRCLVSLPEGYKRSIKWPKSREKIWYTNIPHTKLAEVKGHQNWVKMSGEYLTFPGGGTQFKNGALHYIDFLQESYPDIAWGNRTRVILDVGCGVASFGGYLFDRDVLALSFAPKDEHEAQVQFALERGIPAMSNVMGTKRLPFPGSVFDLIHCARCRVPWHIEGGKLLLELNRALRPGGFFVWSATPVYRKTEEDVGIWKAMSKLTKAMCWELMTIKKDELNEVGAAIYQKPMSNKCYNERSQNEPPLCKDSDDQNAAWNVPLEACIHKVTEDSSKRGAVWPESWPERVETVPQWLDSQEGVYGKPAQEDFTADHERWKTIVSKSYLNGMGIDWSYVRNVMDMRAVYGGFAAALKDLKLWVMNVVPIDSPDTLPIIYERGLFGIYHDWCESFSTYPRTYDLLHADHLFSSLKKRCNLVGVMAEVDRILRPQGTFIVRDDMETIGEIEKMVKSMKWNVRMTHSKDGEGLLSVQKSWWRPTEAETIQSAIA

SEQ ID NO: 509 - DNA, 1198 bp, Arabidopsis thaliana
  G866
aaaaaaaacttgcacatcttctcagatcttcaagtttctcctctggtttctcatcatgaccgttgatattatgcgtttacctaagatggaagatcaaacggctatacaagaagctgcatcacaaggcttaaaaagcatggaacacttgattcgtgtcctctctaaccgtcccgaagaacgtaacgttgattgctctgagatcactgatttcacagtttctaagttcaagaaagttatctctcttcttaaccgttccggtcacgcccggtttagacgtggtccggttcattcccctccttcctcctccgttcctccaccggtgaaagtgacaactccggctcccactcagatctctgctccagcaccggttagcttcgttcaggcaaatcaacaaagcgtgacgttagatttcactagaccgagcgtttttggcgctaaaaccaagagctcggaggttgttgagtttgctaaagagagctttagcgtatcttctaactcttctttcatgtcttctgcgatcaccggtgatggaagtgtctctaaaggctcttcgatctttcttgctccggctccagcggtgccagtgacttcctccgggaaaccgccgctttctggtcttccttacaggaagagatgctttgaacatgaccactctgaaggcttttccggcaagatctctggctccggcaacggcaagtgccattgcaagaaaagccgaaaaaatcggatgaagagaaccgtgagagtaccggcggtaagtgcaaagatcgccgatataccaccagacgaatattcatggagaaagtatggacaaaaaccgatcaaaggctcaccacatccacggggttattacaagtgtagtacatttagaggatgtccagcgaggaaacacgtggaaagagctttggatgattcaacgatgttgattgtgacgtacgaaggagagcaccgtcatcaccagtccacgatgcaggagcatgtaactcctagcgtgagtggtttggtgtttggttcggcttgaagaattaattagtttggtagttttgtaatattttgagaaatagaggggttggttttgtaattttttttctataacaaaattagttttagatttttttttagtagtcttttgaatggattttaatcttactaccgagaaagaaaaaattcttactacattttcaaaaaaaaaaaaaaa

SEQ ID NO: 510 - protein, 321 aa, Arabidopsis thaliana
  G866
MTVDIMRLPKMEDQTAIQEAASQGLKSMEHLIRVLSNRPEERNVDCSEITDFTVSKFKKVISLLNRSGHARFRRGPVHSPPSSSVPPPVKVTTPAPTQISAPAPVSFVQANQQSVTLDFTRPSVFGAKTKSSEVVEFAKESFSVSSNSSFMSSAITGDGSVSKGSSIFLAPAPAVPVTSSGKPPLSGLPYRKRCFEHDHSEGFSGKISGSGNGKCHCKKSRKNRMKRTVRVPAVSAKIADIPPDEYSWRKYGQKPIKGSPHPRGYYKCSTFRGCPARKHVERALDDSTMLIVTYEGEHRHHQSTMQEHVTPSVSGLVFGSA

SEQ ID NO: 511 - DNA, 891 bp, Arabidopsis thaliana
  G872
ccggaaacagaatccaattcaaccaaaccgaatcgaaccgaaccggagtttttatccaatggtgaagcaagcgatgaaggaagaggagaagaagagaaacacggcgatgcagtcaaagtacaaaggagtgaggaagaggaaatggggaaaatgggtatcggagatcagacttccacacagcagagaacgaatttggttaggctcttacgacactcccgagaaggcggcgcgtgctttcgacgccgctcaattttgtctccgcggcggcgatgctaatttcaatttccctaataatccaccgtcgatctccgtagaaaagtcgttgacgcctccggagattcaggaagctgctgctagattcgctaacacattccaagacattgtcaagggagaagaagaatcgggtttagtacccggatccgagatccgaccagagtctccttctacatctgcatctgttgctacatcgacggtggattatgatttttcgtttttggatttgcttccgatgaatttcgggtttgattccttctccgacgacttctctggcttctccggtggtgatcgatttacagagattttacccatcgaagattacggaggagagagtttattagatgaatctttgattctttgggatttttgaattcccaaacataatatttttttagagcgaactgtgagattttccttggagtcatggagaaatctggagattttttgtaacacggagctccaatgacccgggaatttctttcgtttcggatccgaatttgatgtggatcatattcacacctatattttttcatttttttgttgtaaagaaaaatcggataagattctagtaataaatgttaaaagtccatttcattaaaaaaaaaaaaaaaaaaa

SEQ ID NO: 512 - protein, 195 aa, Arabidopsis thaliana
  G872
MVKQAMKEEEKKRNTAMQSKYKGVRKRKWGKWVSEIRLPHSRERIWLGSYDTPEKAARAFDAAQFCLRGGDANFNFPNNPPSISVEKSLTPPEIQEAAARFANTFQDIVKGEEESGLVPGSEIRPESPSTSASVATSTVDYDFSFLDLLPMNFGFDSFSDDFSGFSGGDRFTEILPIEDYGGESLLDESLILWDF

SEQ ID NO: 513 - DNA, 1005 bp, Arabidopsis thaliana
  G904
atggaatctctcatcaatcccagccatggcggaggaaactacgattctcactcttcttctctcgatagtctcaaaccaagcgtactagtcatcattctcattctcctcatgactcttctcatctccgtttccatttgcttcctcctccgctgtctcaatcgctgtagccaccgctccgttctccctctttcatcttcctcttccgtcgcaaccgtaacttccgattcccgacgattctctggacatcgagtctctcccgaaacagaacggtcctccgtgcttgattcgcttccgattttcaaattctcctccgtcactcgccgatctagctccatgaattccggagattgcgccgtttgtttgtcgaaattcgaaccggaggatcagctccgtcttcttcctctctgttgtcacgcttttcacgccgattgtatcgatatctggctagtctctaaccagacttgtcctctctgtcgctctcctctcttcgcttcagaatctgatctcatgaagtctctcgccgtcgtcggctcaaacaacggcggaggagaaaacagcttccgtctcgaaatcggatccatcagccgtcgtcgtcaaacaccgattccagaatccgttgagcagcatcgaacttactcaatcggttcgttcgattacatagtagacgacgtagattcagaaatctcagagtcaaatttcaaccgtggaaaacaggaagacgcgactacaacaactgccacagcaacggcggttacgactaatccgacgtcgtttgaagctagtttagcggcggatataggtaacgatggttctagaagctggctcaaggattacgttgacagactctcacgaggtatatcgtcgcgtgcaatgtcgtttagaagctctggtagattttttactgggagtagtcgtcggagtgaggaattgacggtgatggatttagaagcgaatcatgccggagaagagataagtgagcttttccggtggctctcaggggtgtga

SEQ ID NO: 514 - protein, 334 aa, Arabidopsis thaliana
  G904
MESLINPSHGGGNYDSHSSSLDSLKPSVLVIILILLMTLLISVSICFLLRCLNRCSHRSVLPLSSSSSVATVTSDSRRFSGHRVSPETERSSVLDSLPIFKFSSVTRRSSSMNSGDCAVCLSKFEPEDQLRLLPLCCHAFHADCIDIWLVSNQTCPLCRSPLFASESDLMKSLAVVGSNNGGGENSFRLEIGSISRRRQTPIPESVEQHRTYSIGSFDYIVDDVDSEISESNFNRGKQEDATTTTATATAVTTNPTSFEASLAADIGNDGSRSWLKDYVDRLSRGISSRAMSFRSSGRFFTGSSRRSEELTVMDLEANHAGEEISELFRWLSGV

SEQ ID NO: 515 - DNA, 724 bp, Arabidopsis thaliana
  G912
catcttatccaaagaaaaaatgaatccattttactctacattcccagactcgtttctctcaatctccgatcatagatctccggtttcagacagtagtgagtgttcaccaaagttagcttcaagttgtccaaagaaacgagctgggaggaagaagtttcgtgagacacgtcatccgatttacagaggagttcgtcagaggaattctggtaaatgggtttgtgaagttagagagcctaataagaaatctaggatttggttaggtacttttccgacggttgaaatggctgctcgtgctcatgatgttgctgctttagctcttcgtggtcgctctgcttgtctcaatttcgctgattctgcttggcggcttcgtattcctgagactacttgtcctaaggagattcagaaagctgcgtctgaagctgcaatggcgtttcagaatgagactacgacggagggatctaaaactgcggcggaggcagaggaggcggcaggggagggggtgagggagggggagaggagggcggaggagcagaatggtggtgtgttttatatggatgatgaggcgcttttggggatgcccaacttttttgagaatatggcggaggggatgcttttgccgccgccggaagttggctggaatcataacgactttgacggagtgggtgacgtgtcactctggagttttgacgagtaattttttggctctttttctggataataagtt

SEQ ID NO: 516 - protein, 224 aa, Arabidopsis thaliana
  G912
MNPFYSTFPDSFLSISDHRSPVSDSSECSPKLASSCPKKRAGRKKFRETRHPIYRGVRQRNSGKWVCEVREPNKKSRIWLGTFPTVEMAARAHDVAALALRGRSACLNFADSAWRLRIPETTCPKEIQKAASEAAMAFQNETTTEGSKTAAEAEEAAGEGVREGERRAEEQNGGVFYMDDEALLGMPNFFENMAEGMLLPPPEVGWNHNDFDGVGDVSLWSFDE

SEQ ID NO: 517 - DNA, 1519 bp, Arabidopsis thaliana
  G932
ccacgcgtccgaccacttgtacctctttgtcttaagtactctttaaccctacaatttcctaagctctcaagccacaaaaaaccacaaaccgttcttcaccaatatatatatctgatcatcatcaaagtccttctctctgctcataccacaaaccgttccattcttcccctaatcacaaagtgatatttacatagagaagatagagatgggaagaccaccatgctgtgacaagattggagtgaagaaaggaccatggacaccagaggaagatatcatcttggtttcttacatccaagaacatggtcctggaaactggagatctgtgcctactcacacaggtttgaggagatgtagcaaaagctgtagattgaggtggactaattatcttcgacctgggatcaagcgtggaaatttcaccgagcatgaagagaagatgattctccatcttcaagctcttttgggaaacaggtgggcagctatagcatcatatcttccagaaaggacagacaatgatataaagaactattggaacactcatttgaagaaaaagctcaagaagatgaatgattcttgtgatagtactatcaacaatggccttgataataaagacttctccatatcaaacaaaaacactacctcacatcaaagcagcaactccagtaaaggtcaatgggagagaaggcttcagacagatatcaacatggctaaacaagctctttgtgatgccttgtctattgacaaaccacaaaacccaactaatttttctattcccgatcttggttatggtccatcatcttcttcgtcctctaccaccaccaccaccaccaccaccaccacgagaaacactaatccatacccatctggggtctatgcttcaagtgctgagaacattgctcgtttgcttcagaattttatgaaagacacaccaaagacctcggtgcccttgccggttgcagccaccgagatggctatcaccacggcagcttcgagccctagcacaaccgaaggagacggagaagggattgaccattctttgttcagcttcaactccatagatgaagctgaagagaagcctaaactaatagaccatgacattaatggtctaattacacaaggctctctttctttgttcgagaaatggctctttgatgagcaaagccacgatatgatcatcaataacatgtcactagagggtcaggaagtgttgttctagaaagcattaaagtttgacgatttgcttgaggaaccacgaggcttagttataaacaatttgtataattaagtactctttagttttgttttcaatccttattatgatcatattgcagtaattagggattttagtctttagtagtaactcttaagttttaacacatttttctctatctttttagtagtaactctttattttttccttaaatctttgtcgacgtggagatgatatcttctatgtagtagaaactcaaaagtgtacatcatctttattaatgtaacgtctttttaaaaaaaaaaaaaaaaa

SEQ ID NO: 518 - protein, 335 aa, Arabidopsis thaliana
  G932
MGRPPCCDKIGVKKGPWTPEEDIILVSYIQEHGPGNWRSVPTHTGLRRCSKSCRLRWTNYLRPGIKRGNFTEHEEKMILHLQALLGNRWAAIASYLPERTDNDIKNYWNTHLKKKLKKMNDSCDSTINNGLDNKDFSISNKNTTSHQSSNSSKGQWERRLQTDINMAKQALCDALSIDKPQNPTNFSIPDLGYGPSSSSSSTTTTTTTTTTRNTNPYPSGVYASSAENIARLLQNFMKDTPKTSVPLPVAATEMAITTAASSPSTTEGDGEGIDHSLFSFNSIDEAEEKPKLIDHDINGLITQGSLSLFEKWLFDEQSHDMIINNMSLEGQEVLF

SEQ ID NO: 519 - DNA, 2022 bp, Arabidopsis thaliana
  G958
cgtcgacatgttcatatttgtttctagctaagaagtttgtataaggcagtggacatggctcctgtttcaatgcctccaggtttccggtttcatccaacagacgaagagcttgtcatatactacctcaagcgaaagattaatggtcggactattgagttagagataatacccgagattgatctttacaaatgcgaaccttgggatttacctgggaagtccttgctgccaagtaaagacctagaatggttctttttcagtcctcgagaccggaaatatccaaacggatcaagaacaaaccgggcgaccaaagcaggttactggaaagccaccgggaaagatcgtaaagtgacttcacattcacggatggttggaacaaagaaaacattagtttattaccgaggaagagcgcctcatggctctcgtaccgattgggtcatgcacgagtaccgtcttgaagaacaagaatgtgactctaaatccggtatacaggatgcctatgcactttgtcgagtatttaagaagagtgctttagccaacaaaattgaagaacaacaccatggtacgaagaagaacaaaggaacgactaatagtgaacaatctacttctagtacttgtttgtattctgatggaatgtatgaaaacctcgaaaactcggggtatccagtctcacctgagacaggaggcttaactcaactcggtaataattcgtcgtcggatatggaaacgatagagaataaatggagtcagtttatgtcgcatgacacgtccttcaacttcccacctcagtctcaatatggaacaatctcatatcctccctcgaaggttgatatagcgttagagtgtgcaagactacaaaatcgtatgttgccaccagtaccaccactttacgtagaaggtctcacacacaatgaatattttggaaacaatgtagctaacgatacagatgaaatgttgagcaagattatagcattggctcaagcctcacatgagccacgaaacagtctagactcatgggacggtggttctgcttccgggaacttccatggagactttaactattccggagaaaaagtctcatgcctagaggcgaacgtggaggctgtagatatgcaagaacaccatgtgaattttaaggaagaaagacttgttgaaaacttgagatgggtaggagtatcaagcaaggaacttgaaaagagcttcgttgaagaacactcaacggtaattcctatagaagatatttggagatatcataatgataatcaagaacaagaacatcatgatcaagatggtatggacgttaacaacaacaatggagatgtggatgatgctttcacactcgagttttcggaaaacgaacataacgagaatcttttggacaagaacgatcatgagacaacgagttcctcatgttttgaggtggtaaaaaaagttgaggttagccatggattgtttgtcacaactcgtcaggtaaccaacacattcttccaacagatagtaccatcgcaaaccgttatagtttatataaatccgacggatggcaatgagtgttgtcatagtatgacatcaaaagaggaggttcatgtccgtaaaaagataaatccgcgaatcaacggagtaagctcaacagttcttggacaatggagaaaattcgcgcatgttattggcttcattcctatgcttctattgatgcgttgtgttcatcgaggtaactctaacaaaaacagaggcagtgaaggttactcgaggcagcctacgagaggagattgtaacaatcggggaacaatactcatgatggaaaatgctgtcgtgagaagaaaaatttggaagaagaagaaagagaaaaatatggttgacgaacaaggttttcggtttcaagatagtttcgtattgaagaagttggggctttctcttgctatcatcttagctgtttctaccataagtcttatttgaatactgaggttcaatatatcatatatggcttttcacttttctattgtactcccatttgcctaggtcgtatgc

SEQ ID NO: 520 - protein, 631 aa, Arabidopsis thaliana
  G958
MAPVSMPPGFRFHPTDEELVIYYLKRKINGRTIELEIIPEIDLYKCEPWDLPGKSLLPSKDLEWFFFSPRDRKYPNGSRTNRATKAGYWKATGKDRKVTSHSRMVGTKKTLVYYRGRAPHGSRTDWVMHEYRLEEQECDSKSGIQDAYALCRVFKKSALANKIEEQHHGTKKNKGTTNSEQSTSSTCLYSDGMYENLENSGYPVSPETGGLTQLGNNSSSDMETIENKWSQFMSHDTSFNFPPQSQYGTISYPPSKVDIALECARLQNRMLPPVPPLYVEGLTHNEYFGNNVANDTDEMLSKIIALAQASHEPRNSLDSWDGGSASGNFHGDFNYSGEKVSCLEANVEAVDMQEHHVNFKEERLVENLRWVGVSSKELEKSFVEEHSTVIPIEDIWRYHNDNQEQEHHDQDGMDVNNNNGDVDDAFTLEFSENEHNENLLDKNDHETTSSSCFEVVKKVEVSHGLFVTTRQVTNTFFQQIVPSQTVIVYINPTDGNECCHSMTSKEEVHVRKKINPRINGVSSTVLGQWRKFAHVIGFIPMLLLMRCVHRGNSNKNRGSEGYSRQPTRGDCNNRGTILMMENAVVRRKIWKKKKEKNMVDEQGFRFQDSFVLKKLGLSLAIILAVSTISLI

SEQ ID NO: 521 - DNA, 1221 bp, Arabidopsis thaliana
  G964
atttctcttccacaaagagtcctaacttcgagttgaaacaaacaccatttctcatctctatctcagaaagaacaaaccatttcgtgttctttctttctctattctcataaggaaatataattcctgaaactgttgagttcttgtgaaaggaaataaaaaacatgatgatgggcaaagaagatctaggtttgagcctaagcttagggttttcacaaaatcacaatcctcttcagatgaatctgaatcctaactcttcattatcaaacaatctccagagactcccatggaaccaaacattcgatcctacatcagatcttcgcaagatagacgtgaacagttttccatcaacggttaactgcgaggaagacacaggagtttcgtcaccaaacagtacgatctcaagcaccattagcgggaagagaagtgagagagaaggaatctccggaaccggcgttggctccggcgacgatcacgacgagatcactccggatcgagggtactcacgtggaacctcagatgaagaagaagacgggggcgaaacgtcgaggaagaagctcaggttatcaaaagatcagtctgcttttctcgaagagactttcaaagaacacaacactctcaatcccaaacagaagctagctttggctaagaagctgaacttgacggcaagacaagtggaagtgtggttccaaaacagaagagctagaaccaagttaaagcaaacggaggtagattgcgaatacttgaaacggtgcgtagagaagctaacggaagagaaccggagacttcagaaagaggctatggagcttcgaactctcaagctgtctccacaattctacggtcagatgactccaccaactacactcatcatgtgtccttcgtgcgagcgtgtagctggtccatcatcatcgaaccatcaccacaatcacaggccggtttcgattaacccgtggattgcttgtgctggtcaggtggctcatgggctgaattttgaagccttgcgtccacgatcgtaatttttagtggtgggggaagggtgttttgggttttttcattatcgttatatagtctatctgtgtggggtcattgtaattttggatgattggccttctcatgaactagtcatatgtatgatgcaaccttaaaaatatttcaagtagcaaaacttaattacaaacttgctatattaaccaaaaattatgaaaaaaaaaaaaaaaaaaaaaa

SEQ ID NO: 522 - protein, 283 aa, Arabidopsis thaliana
  G964
MMMGKEDLGLSLSLGFSQNHNPLQMNLNPNSSLSNNLQRLPWNQTFDPTSDLRKIDVNSFPSTVNCEEDTGVSSPNSTISSTISGKRSEREGISGTGVGSGDDHDEITPDRGYSRGTSDEEEDGGETSRKKLRLSKDQSAFLEETFKEHNTLNPKQKLALAKKLNLTARQVEVWFQNRRARTKLKQTEVDCEYLKRCVEKLTEENRRLQKEAMELRTLKLSPQFYGQMTPPTTLIMCPSCERVAGPSSSNHHHNHRPVSINPWIACAGQVAHGLNFEALRPRS

SEQ ID NO: 523 - DNA, 1530 bp, Arabidopsis thaliana
  misc_feature (1499)..(1500): n is a, c, g, or t
  misc_feature (1503)..(1503): n is a, c, g, or t
  misc_feature (1505)..(1505): n is a, c, g, or t
  misc_feature (1507)..(1507): n is a, c, g, or t
  misc_feature (1512)..(1512): n is a, c, g, or t
  misc_feature (1514)..(1514): n is a, c, g, or t
  misc_feature (1518)..(1518): n is a, c, g, or t
  G979
cctctgaggaatcaaatcactcacactccaaaaaaaaatctaaactttctcagagtttaatgaagaagcgcttaaccacttccacttgttcttcttctccatcttcctctgtttcttcttctactactacttcctctcctattcagtcggaggctccaaggcctaaacgagccaaaagggctaagaaatcttctccttctggtgataaatctcataacccgacaagccctgcttctacccgacgcagctctatctacagaggagtcactagacatagatggactgggagattcgaggctcatctttgggacaaaagctcttggaattcgattcagaacaagaaaggcaaacaagtttatctgggagcatatgacagtgaagaagcagcagcacatacgtacgatctggctgctctcaagtactggggacccgacaccatcttgaattttccggcagagacgtacacaaaggaattggaagaaatgcagagagtgacaaaggaagaatatttggcttctctccgccgccagagcagtggtttctccagaggcgtctctaaatatcgcggcgtcgctaggcatcaccacaacggaagatgggaggctcggatcggaagagtgtttgggaacaagtacttgtacctcggcacctataatacgcaggaggaagctgctgcagcatatgacatggctgcgattgagtatcgaggcgcaaacgcggttactaatttcgacattagtaattacattgaccggttaaagaagaaaggtgttttcccgttccctgtgaaccaagctaaccatcaagagggtattcttgttgaagccaaacaagaagttgaaacgagagaagcgaaggaagagcctagagaagaagtgaaacaacagtacgtggaagaaccaccgcaagaagaagaagagaaggaagaagagaaagcagagcaacaagaagcagagattgtaggatattcagaagaagcagcagtggtcaattgctgcatagactcttcaaccataatggaaatggatcgttgtggggacaacaatgagctggcttggaacttctgtatgatggatacagggttttctccgtttttgactgatcagaatctcgcgaatgagaatcccatagagtatccggagctattcaatgagttagcatttgaggacaacatcgacttcatgttcgatgatgggaagcacgagtgcttgaacttggaaaatctggattgttgcgtggtgggaagagagagcccaccctcttcttcttcaccattgtcttgcttatctactgactctgcttcatcaacaacaacaacaacaacctcggtttcttgtaactatttggtctgagagagagagctttgccttctagtttgaatttctatttcttccgcttcttcttcttttttttcttttgttgggttctgcttagggtttgtatttcagtttcagggcttgttcgttggttctgaataatcaatgtctttgccccttttnnaangntncaagntnaaanaaaaaaaaaaaa

SEQ ID NO: 524 - protein, 430 aa, Arabidopsis thaliana
  G979
MKKRLTTSTCSSSPSSSVSSSTTTSSPIQSEAPRPKRAKRAKKSSPSGDKSHNPTSPASTRRSSIYRGVTRHRWTGRFEAHLWDKSSWNSIQNKKGKQVYLGAYDSEEAAAHTYDLAALKYWGPDTILNFPAETYTKELEEMQRVTKEEYLASLRRQSSGFSRGVSKYRGVARHHHNGRWEARIGRVFGNKYLYLGTYNTQEEAAAAYDMAAIEYRGANAVTNFDISNYIDRLKKKGVFPFPVNQANHQEGILVEAKQEVETREAKEEPREEVKQQYVEEPPQEEEEKEEEKAEQQEAEIVGYSEEAAVVNCCIDSSTIMEMDRCGDNNELAWNFCMMDTGFSPFLTDQNLANENPIEYPELFNELAFEDNIDFMFDDGKHECLNLENLDCCVVGRESPPSSSSPLSCLSTDSASSTTTTTTSVSCNYLV

SEQ ID NO: 525 - DNA, 725 bp, Arabidopsis thaliana
  G1049
ctaactttcttcccaagtaaacttcaaaatgcagccgcaaacagacgttttcagcctccataactacctaaactcatcgatactgcagtctccgtatccttctaatttcccgatatctacgccatttccaaccaacggtcaaaacccgtacctcctctacggattccaaagccctacaaacaatccacaatccatgagcctaagcagcaacaactcaacatcagatgaagcagaagagcagcagacgaacaacaatataatcaacgagcggaagcagagaaggatgatttcaaaccgagaatccgcaaggagatcgcgtatgaggaagcaaagacaccttgacgagctttggtcacaagtgatgtggttaaggatcgagaatcatcagttgcttgataagcttaacaatctctctgagtctcacgacaaggttcttcaagagaatgctcagcttaaagaagaaacatttgagcttaagcaagtgatcagcgatatgcaaattcaaagccctttctcttgctttagagacgatataatccccattgaataaagcatttttccccgattcatatttatgaaaattttcttcaagagtatgtttctttgtatgtatatgtggagatgtatttcagggttttgataatatgaccctttacgacgacgtttttagattgtagtaaatttataaactaaagaagattagtgttaatgaagaacaaatataa

SEQ ID NO: 526 - protein, 173 aa, Arabidopsis thaliana
  G1049
MQPQTDVFSLHNYLNSSILQSPYPSNFPISTPFPTNGQNPYLLYGFQSPTNNPQSMSLSSNNSTSDEAEEQQTNNNIINERKQRRMISNRESARRSRMRKQRHLDELWSQVMWLRIENHQLLDKLNNLSESHDKVLQENAQLKEETFELKQVISDMQIQSPFSCFRDDIIPIE

SEQ ID NO: 527 - DNA, 1746 bp, Arabidopsis thaliana
  G1246
atgatcatgtacggaggaggaggagcagggaaggacggtggatccaccaatcacttatcagacggaggagtgatattgaagaaaggtccatggacggcggcggaagatgagatacttgctgcgtacgttagagagaacggtgaagggaattggaacgccgttcagaaaaacacaggtttggctcgttgcggcaaaagctgccgtcttcgatgggccaatcacctccgaccaaatctgaaaaaaggctctttcaccggtgacgaagaacgtctcatcattcagcttcatgctcagcttggtaacaaatgggctcgcatggctgctcagttaccgggaagaacagacaacgagattaagaactattggaacacgagattgaaacgacttcttcgccaaggacttcctctttatcctccagatattatccctaaccatcaactccatccacatccacatcatcaacaacaacagcaacataaccatcatcatcatcatcatcaacaacaacaacaacatcaacaaatgtattttcaaccacaatcttcacaacgaaacacaccatcatcttcccctcttccatctccaacaccagcaaacgcaaagtcctcatcatccttcacttttcataccacgactgctaacctcctccatccacttagccctcacactccaaacacaccatctcaactctcttccacaccgcctccaccaccactttcctctcctttatgttcccctcgcaacaaccaatacccgacccttcccctctttgccctcccgcgttcccaaatcaacaacaacaacaacggaaatttcactttccctagacctccacctctccttcaaccgccttcatcactcttcgcaaaacgttacaacaatgctaacactcctcttaattgcatcaaccgcgtctcaaccgcaccattttcccctgtttcaagagactcctacacttcctttcttacattgccttacccttccccaaccgctcaaaccgctacttaccacaatactaataacccttactcttcctctccttccttctctttaaacccttcttcttcttcttaccctacatcaacttcttccccaagctttcttcactcccattacactccttcttccacctcatttcataccaacccagtttactccatgaaacaagagcagctcccttcaaaccaaattccccaaatagatggcttcaataacgtcaacaacttcacagacaacgagagacagaatcataaccttaacagttccggtgctcatagaagaagtagtagctgcagcctcttagaggatgtcttcgaagaggccgaagctttagcctctggaggcagaggccgacctccaaaacgaagacaactcacagcttctcttccgaaccacaacaacaacaccaacaacaacgacaacttcttctcggttagtttcggacattatgattcttctgacaacttatgttccttgcaagatttgaaatcaaaggaagaagagtctcttcaaatgaacacaatgcaggaggacatagctaagcttcttgattggggaagtgatagtggagagatctctaatggacaatcatctgttgtcactgacgacaatcttgttcttgatgttcatcaattagcttcactattcccggctgattctacagccgtcgtagccgcaacaaacgaccaacacaacaagaataataacaataattgttcctgggatgacatgcagggaataaggtag

SEQ ID NO: 528 - protein, 581 aa, Arabidopsis thaliana
  G1246
MIMYGGGGAGKDGGSTNHLSDGGVILKKGPWTAAEDEILAAYVRENGEGNWNAVQKNTGLARCGKSCRLRWANHLRPNLKKGSFTGDEERLIIQLHAQLGNKWARMAAQLPGRTDNEIKNYWNTRLKRLLRQGLPLYPPDIIPNHQLHPHPHHQQQQQHNHHHHHHQQQQQHQQMYFQPQSSQRNTPSSSPLPSPTPANAKSSSSFTFHTTTANLLHPLSPHTPNTPSQLSSTPPPPPLSSPLCSPRNNQYPTLPLFALPRSQINNNNNGNFTFPRPPPLLQPPSSLFAKRYNNANTPLNCINRVSTAPFSPVSRDSYTSFLTLPYPSPTAQTATYHNTNNPYSSSPSFSLNPSSSSYPTSTSSPSFLHSHYTPSSTSFHTNPVYSMKQEQLPSNQIPQIDGFNNVNNFTDNERQNHNLNSSGAHRRSSSCSLLEDVFEEAEALASGGRGRPPKRRQLTASLPNHNNNTNNNDNFFSVSFGHYDSSDNLCSLQDLKSKEEESLQMNTMQEDIAKLLDWGSDSGEISNGQSSVVTDDNLVLDVHQLASLFPADSTAVVAATNDQHNKNNNNNCSWDDMQGIR

SEQ ID NO: 529 - DNA, 1538 bp, Arabidopsis thaliana
  G1255
cagctcaaactctctaggactacactaaatctaactttttgcagagagcaaaagattcaataattgagattgatctcaaaaccaaagctctcgtgctcttgtcgttgatgttggttgtgtagactttgtatacaatgatgaaaagtttggcgaatgctgttggagcgaagacggcgagggcttgcgacagctgcgtgaagagacgtgcacggtggtactgcgcggccgacgatgcttttctttgccagtcttgcgacagtttggtccattcagcaaaccctcttgctcgccgccacgagagagtccgtttgaagacggctagcccggcggtcgtaaagcatagcaaccactcatcagcttctcctccacatgaggtcgccacgtggcatcacgggtttactcgtaaagctcgaacgccacgtggctctggtaagaaaaacaattcgtcgatatttcatgacttggttcctgatattagtattgaggatcagacagacaactatgagcttgaagagcagctgatctgtcaagtgccggttctagatccgttggtgtctgagcagttcttgaacgatgtcgttgagcccaagatcgagtttcctatgatcagaagtggtttgatgatcgaggaggaggaagacaacgctgaaagttgtcttaatggatttttcccgaccgacatggagcttgaggagtttgctgctgacgtggagactctgctcggtcgcgggttagacacggagtcgtatgccatggaggagctagggttatctaattcagagatgttcaaaatcgaaaaagatgagattgaagaagaagtagaagagataaaagccatgagcatggatatatttgatgatgatcgaaaagacgtggatggaacagtaccgtttgagctaagctttgattacgagtcgtcacacaagacgtccgaagaagaggtaatgaagaacgttgaaagtagtggtgaatgtgttgttaaggtgaaagaggaagaacataagaatgttctgatgctaagattaaactatgactcggtgatatccacttggggaggtcaaggtccaccgtggagttcaggagagccaccggaacgagacatggacatcagcggttggccagccttttccatggtggagaatggaggagaaagtactcatcagaagcaatacgttggtggatgtttaccatcaagtgggtttggagatggaggtagagaagctagagtttcgagatacagagagaagaggaggacaaggttgttttctaagaagatacggtacgaggtacgtaaattgaatgcagagaaaagaccacgaatgaaaggaagattcgtgaagagagcctcgctcgctgctgctgcttcaccattaggtgttaattactgaatagttaatatctattcatgttatatctcactttacaaatttcggtgaatcttttttcttctgaaacaacagaagttattttggcacttaattgtgctttgaggacttgtatgtacatagaagtaaccaataataatgtgacttttacta

SEQ ID NO: 530 - protein, 416 aa, Arabidopsis thaliana
  G1255
MKSLANAVGAKTARACDSCVKRRARWYCAADDAFLCQSCDSLVHSANPLARRHERVRLKTASPAVVKHSNHSSASPPHEVATWHHGFTRKARTPRGSGKKNNSSIFHDLVPDISIEDQTDNYELEEQLICQVPVLDPLVSEQFLNDVVEPKIEFPMIRSGLMIEEEEDNAESCLNGFFPTDMELEEFAADVETLLGRGLDTESYAMEELGLSNSEMFKIEKDEIEEEVEEIKAMSMDIFDDDRKDVDGTVPFELSFDYESSHKTSEEEVMKNVESSGECVVKVKEEEHKNVLMLRLNYDSVISTWGGQGPPWSSGEPPERDMDISGWPAFSMVENGGESTHQKQYVGGCLPSSGFGDGGREARVSRYREKRRTRLFSKKIRYEVRKLNAEKRPRMKGRFVKRASLAAAASPLGVNY

SEQ ID NO: 531 - DNA, 859 bp, Arabidopsis thaliana
  G1266
caatccactaacgatccctaaccgaaaacagagtagtcaagaaacagagtattttttctacatggatccatttttaattcagtccccattctccggcttctcaccggaatattctatcggatcttctccagattctttctcatcctcttcttctaacaattactctcttcccttcaacgagaacgactcagaggaaatgtttctctacggtctaatcgagcagtccacgcaacaaacctatattgactcggatagtcaagaccttccgatcaaatccgtaagctcaagaaagtcagagaagtcttacagaggcgtaagacgacggccatgggggaaattcgcggcggagataagagattcgactagaaacggtattagggtttggctcgggacgttcgaaagcgcggaagaggcggctttagcctacgatcaagctgctttctcgatgagagggtcctcggcgattctcaatttttcggcggagagagttcaagagtcgctttcggagattaaatatacctacgaggatggttgttctccggttgtggcgttgaagaggaaacactcgatgagacggagaatgaccaataagaagacgaaagatagtgactttgatcaccgctccgtgaagttagataatgtagttgtctttgaggatttgggagaacagtaccttgaggagcttttggggtcttctgaaaatagtgggacttggtgaaagattaggatttgtattagggaccttaagtttgaagtggttgattaattttaaccctaatatgttttttgtttgcttaaatatttgattctattgagaaacatcgaaaacagtttgtatgtacttttgtgatacttggcg

SEQ ID NO: 532 - protein, 218 aa, Arabidopsis thaliana
  G1266
MDPFLIQSPFSGFSPEYSIGSSPDSFSSSSSNNYSLPFNENDSEEMFLYGLIEQSTQQTYIDSDSQDLPIKSVSSRKSEKSYRGVRRRPWGKFAAEIRDSTRNGIRVWLGTFESAEEAALAYDQAAFSMRGSSAILNFSAERVQESLSEIKYTYEDGCSPVVALKRKHSMRRRMTNKKTKDSDFDHRSVKLDNVVVFEDLGEQYLEELLGSSENSGTW

SEQ ID NO: 533 - DNA, 786 bp, Arabidopsis thaliana
  G1331
atggtggaagaagtttggagaaagggtccatggaccgccgaagaagaccgtcttttgatcgaatacgtccgtgttcacggtgaaggtcgttggaactctgtctctaaactcgcaggattgaaaaggaatggcaaaagctgcagactaagatgggtgaattaccttagaccagacctcaagagaggacagatcactccacatgaagaaagtataatacttgagctacacgctaagtggggaaataggtggtcaacaattgcacgtagtttaccaggaagaacagacaatgagatcaagaactattggagaacccatttcaagaaaaaggcaaagcctacgactaacaatgcggagaagataaagagtcgtctcctaaaaaggcaacacttcaaggaacagagagaaatagagttgcaacaagaacagcagttgtttcagttcgaccaactcggtatgaaaaagatcatctctttactcgaagaaaacaatagcagtagcagtagcgatggcggtggtgatgtgttctattatcctgatcaaataacacattcatcaaaaccctttggctataactctaattcattagaggagcagttacaaggtagattttctcctgtaaacatacctgatgctaatactatgaacgaagacaatgccatatgggacgggttttggaacatggatgttgtaaatggacatggtgggaacttgggtgttgtggctgctactgctgcttgtggcccaaggaagccctatttccataacttggtgattccattttgttaa

SEQ ID NO: 534 - protein, 261 aa, Arabidopsis thaliana
  G1331
MVEEVWRKGPWTAEEDRLLIEYVRVHGEGRWNSVSKLAGLKRNGKSCRLRWVNYLRPDLKRGQITPHEESIILELHAKWGNRWSTIARSLPGRTDNEIKNYWRTHFKKKAKPTTNNAEKIKSRLLKRQHFKEQREIELQQEQQLFQFDQLGMKKIISLLEENNSSSSSDGGGDVFYYPDQITHSSKPFGYNSNSLEEQLQGRFSPVNIPDANTMNEDNAIWDGFWNMDVVNGHGGNLGVVAATAACGPRKPYFHNLVIPFC

SEQ ID NO: 535 - DNA, 606 bp, Arabidopsis thaliana
  G1332
atggaatgcaaaagagaagaagggaagtcttacgtgaagagagggttgtggaaaccagaagaagatatgatattaaaaagctatgttgagactcatggtgaaggaaactgggcagacatttctcgtagatccgggttgaagagaggaggaaaaagctgtaggctgagatggaagaactatctaagaccaaatatcaaaagaggaagcatgtcaccacaagaacaagaccttatcatccgcatgcataagcttcttggaaacagatggtcgttgatcgctggtcgccttccaggtcgtactgacaatgaagtgaagaactactggaatactcatttgaacaagaaacctaattcccgaaaacagaatgcacctgaatcaatcgtcggcgccactcctttcacggataagccagttatgtctacagaactgagaagaagccatggagaaggaggagaagaggagagcaatacctggatggaggagaccaaccactttggctatgacgtccacgtaggatctcccttgccacttatttcccactacccagacaacactctcgtgtttgacccatgtttttcctttaccgatttctttcctctgctttag

SEQ ID NO: 536 - protein, 201 aa, Arabidopsis thaliana
  G1332
MECKREEGKSYVKRGLWKPEEDMILKSYVETHGEGNWADISRRSGLKRGGKSCRLRWKNYLRPNIKRGSMSPQEQDLIIRMHKLLGNRWSLIAGRLPGRTDNEVKNYWNTHLNKKPNSRKQNAPESIVGATPFTDKPVMSTELRRSHGEGGEEESNTWMEETNHFGYDVHVGSPLPLISHYPDNTLVFDPCFSFTDFFPLL

SEQ ID NO: 537 - DNA, 1424 bp, Arabidopsis thaliana
  G1494
tcgacagagttgtgttgggcgtggaacttggactagttccacatatcaggttatatagatcttctctttcaacttctgattcgtccagaagctttcctaatctgagatctgacatggaacaccaaggttggagttttgaggagaattatagtttgtccactaatagaagatctatcaggccacaagatgaactagtggagttattatggcgagatggacaagtggttctgcagagccaaactcatagagaacaaacccaaacccagaaacaagatcatcatgaagaagccctaagatccagcacctttcttgaagatcaagaaactgtctcttggatccaataccctccagatgaagacccattcgaacccgacgacttctcctcccacttcttctcaaccatggatcccctccagagaccaacctcagagacggttaagcctaagtccagtcctgaacctcctcaagtcatggttaagcctaaggcctgtcctgaccctcctcctcaagtcatgcctcctccaaaatttaggttaacaaattcatcatcggggattagggaaacagaaatggaacagtactcggtaacgaccgttggacctagccattgcggaagcaacccatcacagaacgatctcgatgtctcaatgagtcatgatcgaagcaaaaacatagaagaaaagcttaatccgaacgcaagttcctcatcaggtggctcctctggttgcagctttggcaaagatatcaaagaaatggctagtggaagatgcatcacaaccgaccgtaagagaaaacgtataaatcacactgacgaatctgtatctctatcagatgcaatcggtaacaagtcgaaccaacgatcaggatcaaaccgaaggagtcgagcagctgaagttcataatctctccgaaaggaggaggagagataggatcaatgagagaatgaaggctttgcaagaactaatacctcactgcagtaaaactgataaagcttcgattttagacgaagccatagattatttgaaatcacttcagttacagcttcaagtgatgtggatggggagtggaatggcggcggcggcggcttcggctccgatgatgttccccggagttcaacctcagcagttcatacgtcagatacagagcccggtacagttacctcgatttccggttatggatcagtctgcaattcagaacaatcccggtttagtttgccaaaacccggtacaaaaccagatcatctccgaccggtttgctagatacatcggtgggttcccacacatgcaggccgcgactcagatgcagccgatggagatgttgagatttagttcaccggcgggacagcaaagtcaacaaccgtcgtctgtgccgacgaagaccaccgacggttctcgtttggaccactaggttggtgagccactttgc

SEQ ID NO: 538 - protein, 430 aa, Arabidopsis thaliana
  G1494
MEHQGWSFEENYSLSTNRRSIRPQDELVELLWRDGQVVLQSQTHREQTQTQKQDHHEEALRSSTFLEDQETVSWIQYPPDEDPFEPDDFSSHFFSTMDPLQRPTSETVKPKSSPEPPQVMVKPKACPDPPPQVMPPPKFRLTNSSSGIRETEMEQYSVTTVGPSHCGSNPSQNDLDVSMSHDRSKNIEEKLNPNASSSSGGSSGCSFGKDIKEMASGRCITTDRKRKRINHTDESVSLSDAIGNKSNQRSGSNRRSRAAEVHNLSERRRRDRINERMKALQELIPHCSKTDKASILDEAIDYLKSLQLQLQVMWMGSGMAAAAASAPMMFPGVQPQQFIRQIQSPVQLPRFPVMDQSAIQNNPGLVCQNPVQNQIISDRFARYIGGFPHMQAATQMQPMEMLRFSSPAGQQSQQPSSVPTKTTDGSRLDH

SEQ ID NO: 539 - DNA, 2385 bp, Arabidopsis thaliana
  G1535
atgttgacaatgggagaaggtaatgtgatgacttcaaacaacagatttgcttcgccgccgcagcagccgtcttcttcttctccgggaacaatccaaaaccctaatttcaatttcatacctttcaactcatattcatccattatcccgaaggaagagcatgggatgatgagtatgatgatgatgatgggagatggaacagtagaggaaatgatggaaaacgggtcggcgggtgggtcattcgggtcaggtagtgaacaagcagaagatccaaagtttggaaacgaatctgatgtcaatgagcttcatgacgatgaacaacctcctccggctaagaagaaacgttatcacagacacactaatcgtcagatccaagaaatggaagcgttgtttaaagaaaaccctcatccagacgacaaacaaagaaagagattaagtgctgaacttggtcttaagcctcgacaagtcaagttttggttccaaaataggcgtacccaaatgaaggcacaacaagacagaaatgagaatgtgatgttaagggcagagaacgataatcttaagtcggagaattgtcatcttcaggcggagctacggtgcctctcttgtccttcttgcggcggccccaccgtccttggcgacattcctttcaacgagatccacattgagaactgtcgcctccgtgaagagcttgatcgtctgtgctgcattgcctcgagatacactggccgtccgatgcaatctatgccaccatctcagccattgatcaatccttctccgatgcttccacatcatcaaccttcattggagctagacatgagtgtatacgctgggaactttccagaacaatcttgtacagacatgatgatgcttcctccacaagatacagcttgtttcttcccagatcaaactgccaacaataacaacaacaacaacatgttacttgcggatgaagaaaaggttatcgctatggaattcgctgtctcttgtgttcaagaacttactaaaatgtgtgacacagaagagcctttgtggattaagaagaaatcagacaagattggcggcgaaattttgtgtcttaacgaggaagagtacatgaggttgttcccatggccgatggagaatcaaaacaacaaaggagattttcttagagaagcttcaaaggcgaatgcagtcgttatcatgaacagcataacactagttgacgcctttctaaacgctgataaatggtcagagatgttctgttcaatcgtggctagggcgaaaactgttcagataatttcatcaggagtttctggagctagtggttctctccttctgatgtttgcagagttacaggtactatctcctctggttccaactagagaagcttattttcttcggtatgtggaacaaaacgcagaaaccggaaattgggcaatcgtggatttcccgatcgatagcttccatgaccaaatgcagccaatgaatactattactcatgagtataagagaaaaccttcaggctgcatcattcaggacatgcctaatggatactcacaagtcaagtgggtggagcatgttgaagtagacgagaaacatgtgcacgagacttttgctgagtatgtgaaaagcggaatggcttttggagctaaccgttggctcgacgtgttgcagagacaatgcgagaggatcgctagtctaatggctagaaacataactgatcttggagtaatttcatctgcagaagcaaggaggaacataatgaggttatcacagagacttgtgaaaacattctgtgtgaatataagcactgcatatggacagtcttggaccgctttgtctgagacaactaaggacaccgtgaggatcacgacaaggaaaatgtgtgaacctggtcagccaacaggagttgttctttgtgctgtctcaaccacttggcttccattttctcaccatcaagtctttgatcttatccgtgatcaacatcaccaatctctggtcgcaagcaactcatggcataatgttgagctgatgcttcaagaaagctgcattgataactccggtagcttaatcgtctactccaccgtcgacgttgactcaattcagcaggcgatgaacggtgaagattcttccaatattccgattttacccctcggattctccattgtccccgtgaatcctcccgagggtatttccgtcaattcgcattctccgccgtcgtgtcttctcaccgtcgggattcaggtcttggcgagtaacgtcccaacagcgaaaccaaatctctccaccgtcaccaccatcaataaccatctctgcgccaccgttaatcagatcacttctgccctcagcaacaccattacgccggtgattgcatcttccgctgacgtgtccaatcaagaagtcagctag

SEQ ID NO: 540 - protein, 794 aa, Arabidopsis thaliana
  G1535
MLTMGEGNVMTSNNRFASPPQQPSSSSPGTIQNPNFNFIPFNSYSSIIPKEEHGMMSMMMMMGDGTVEEMMENGSAGGSFGSGSEQAEDPKFGNESDVNELHDDEQPPPAKKKRYHRHTNRQIQEMEALFKENPHPDDKQRKRLSAELGLKPRQVKFWFQNRRTQMKAQQDRNENVMLRAENDNLKSENCHLQAELRCLSCPSCGGPTVLGDIPFNEIHIENCRLREELDRLCCIASRYTGRPMQSMPPSQPLINPSPMLPHHQPSLELDMSVYAGNFPEQSCTDMMMLPPQDTACFFPDQTANNNNNNNMLLADEEKVIAMEFAVSCVQELTKMCDTEEPLWIKKKSDKIGGEILCLNEEEYMRLFPWPMENQNNKGDFLREASKANAVVIMNSITLVDAFLNADKWSEMFCSIVARAKTVQIISSGVSGASGSLLLMFAELQVLSPLVPTREAYFLRYVEQNAETGNWAIVDFPIDSFHDQMQPMNTITHEYKRKPSGCIIQDMPNGYSQVKWVEHVEVDEKHVHETFAEYVKSGMAFGANRWLDVLQRQCERIASLMARNITDLGVISSAEARRNIMRLSQRLVKTFCVNISTAYGQSWTALSETTKDTVRITTRKMCEPGQPTGVVLCAVSTTWLPFSHHQVFDLIRDQHHQSLVASNSWHNVELMLQESCIDNSGSLIVYSTVDVDSIQQAMNGEDSSNIPILPLGFSIVPVNPPEGISVNSHSPPSCLLTVGIQVLASNVPTAKPNLSTVTTINNHLCATVNQITSALSNTITPVIASSADVSNQEVS

SEQ ID NO: 541 - DNA, 1471 bp, Arabidopsis thaliana
  G1649
attcacaaaaaccggaaaaaaaaaaagacaagtaaagaaagctttgttcagtttacttcaatggaagcaaaacccttagcatcatcatcatctgaaccaaacatgatttctccatcatcaaacattaaaccaaaattaaaagatgaagattatatggagctggtgtgtgaaaatgggcagattcttgcaaagattcgaagaccaaagaacaacggttcttttcaaaagcaacgtaggcaatctctcctggatttgtatgagaccgagtacagcgagggtttcaagaaaaacatcaagattcttggagacacacaagttgttccggtgagtcagtctaagccacaacaagataaagaaaccaatgaacaaatgaacaacaataagaagaagctaaagtcctccaaaatcgaatttgagagaaatgtttcgaaaagcaacaaatgtgttgaatcatcaacattaattgatgtttctgctaaaggtccaaagaatgttgaagttactacagctcctcctgatgagcaatctgcagctgttggtagatccacggaattgtattttgcttcttcatcgaagttttctcgaggaacttcgagagatctaagttgttgttctttaaagaggaagtatggagatattgaagaagaagaatcaacctatttaagtaataattcagatgatgaatcagatgatgcgaagacacaagttcatgcgagaacaagaaagccggtgactaaaagaaaacgaagcacagaagtccataagttatatgaaagaaaacgaagagatgaattcaacaagaaaatgcgtgctttgcaggacctactaccaaattgttacaaggatgataaggcttcattgttggatgaggctatcaaatatatgcggacccttcaacttcaagttcagatgatgagtatgggaaatggattaataagaccacctacgatgttgccaatgggtcattactctcccatgggtctaggaatgcatatgggtgcagcagcaacaccaacatcaataccgcaattcctgcctatgaatgttcaagcaaccggttttccggggatgaacaatgcaccaccacaaatgctaagctttcttaatcacccaagtggactaattccaaacactcctatcttttctccattggaaaattgctctcagccattcgtggtgccttcgtgtgtttctcagactcaggctacttcttttactcaattcccaaagtctgcgtccgcctcaaacttagaagatgcaatgcaatatagaggaagcaacggttttagttattatcgctcgccaaactaatgatttgtagaaagttgatgttttctccaactaactaactttaagcaaaaaaaaatgatcgtctactctgtgttgttagtctatgggcttttgggccttgattcttggaacgatttgaacttaattccaactattttcaaagtggatgtacaaagtaaaa

SEQ ID NO: 542 - protein, 416 aa, Arabidopsis thaliana
  G1649
MEAKPLASSSSEPNMISPSSNIKPKLKDEDYMELVCENGQILAKIRRPKNNGSFQKQRRQSLLDLYETEYSEGFKKNIKILGDTQVVPVSQSKPQQDKETNEQMNNNKKKLKSSKIEFERNVSKSNKCVESSTLIDVSAKGPKNVEVTTAPPDEQSAAVGRSTELYFASSSKFSRGTSRDLSCCSLKRKYGDIEEEESTYLSNNSDDESDDAKTQVHARTRKPVTKRKRSTEVHKLYERKRRDEFNKKMRALQDLLPNCYKDDKASLLDEAIKYMRTLQLQVQMMSMGNGLIRPPTMLPMGHYSPMGLGMHMGAAATPTSIPQFLPMNVQATGFPGMNNAPPQMLSFLNHPSGLIPNTPIFSPLENCSQPFVVPSCVSQTQATSFTQFPKSASASNLEDAMQYRGSNGFSYYRSPN

SEQ ID NO: 543 - DNA, 1136 bp, Arabidopsis thaliana
  G1750
cccttttcctctctttctccaaatctctgaaaattttcaccagaatctctgttctttttttcaccagaatctctctgtttaaaataataggtgatgatgatggatgagtttatggatcttagaccagtgaagtacacagagcacaagactgttatcagaaagtacactaaaaagtcgtctatggagaggaagaccagtgttcgtgactcggccaggttggttcgggtctcaatgacggatcgtgacgccactgattcatcaagcgacgaggaagagtttctgttccctcgaagacgtgtcaagagattgattaacgagatcagagtcgagcctagcagctcttccaccggcgacgtctctgcttctccgacgaaggaccggaaaagaatcaacgttgattctacggttcaaaagccctctgtttccggccaaaaccagaagaagtaccgcggcgtgagacagcgaccatggggaaaatgggcggcggagattcgtgatcctgagcaacgccggagaatctggctcggtacttttgcaacggcggaggaagctgccatcgtctacgacaacgcagcaatcaaacttcgtggccctgatgctcttaccaacttcaccgtacaaccagaaccagaaccggtacaagaacaagaacaagaaccggagagcaacatgtcggtttcgatatcagaatcaatggacgattctcaacatctatcatctccgacatcggttctcaactaccaaacatatgtctcggaggaaccaatcgatagtcttatcaaaccggttaaacaagagtttcttgaaccagaacaagagccaataagctggcatcttggagaaggtaatactaatactaatgatgattcatttccattggacattacatttctcgacaactatttcaatgaatcattaccagacatctccatcttcgatcaacctatgtctcctattcaaccaacagagaatgatttcttcaacgaccttatgttattcgatagcaacgcagaagaatactactcctccgagatcaaagagattggttcatcgttcaacgatcttgatgattctttgatatccgatctcttacttgtgtgatatttttgccattaaccaaacaccggtttggttgc

SEQ ID NO: 544 - protein, 335 aa, Arabidopsis thaliana
  G1750
MMMDEFMDLRPVKYTEHKTVIRKYTKKSSMERKTSVRDSARLVRVSMTDRDATDSSSDEEEFLFPRRRVKRLINEIRVEPSSSSTGDVSASPTKDRKRINVDSTVQKPSVSGQNQKKYRGVRQRPWGKWAAEIRDPEQRRRIWLGTFATAEEAAIVYDNAAIKLRGPDALTNFTVQPEPEPVQEQEQEPESNMSVSISESMDDSQHLSSPTSVLNYQTYVSEEPIDSLIKPVKQEFLEPEQEPISWHLGEGNTNTNDDSFPLDITFLDNYFNESLPDISIFDQPMSPIQPTENDFFNDLMLFDSNAEEYYSSEIKEIGSSFNDLDDSLISDLLLV

SEQ ID NO: 545 - DNA, 1299 bp, Arabidopsis thaliana
  G1773
atgagttcttcagatcgtgacatcatcgatatcgaatcaggagaagaagatttgtatagcgatggtggtaacgacatcatcgatatcgaatcaggagaggaggatttgtacagcgatggtggtaacgtatccgatgactacaaccctgtggacgacacaattagtcgatctgagaaaagttacgttgttgttaaggaagaagacattcttaagcttcaaagagacgatatcgaacaagtttcgacggttctctctgtaagccaagtggaatcgattgttctgcttcttcactatcattggtgtgttagtaaactcgaagatgaatggtttacggacgaagagagaatccgtaaaaccgttggtatattaaaggagcctgtcgttgatgttaatggtacagaagtggatattcaatgtggaatttgctttgaatcatacactcgaaaggaaattgctagggtttcttgtggtcatccttattgcaagacctgctggactggttacatcactacgaaaatcgaagacggtccgggatgtttaagggttaaatgtcccgaaccttcttgttacgctgttgttggtcaagacatgatcgatgaggttactgagaagaaagataaggacaagtattatagatattttcttaggtcttatgtcgaagacgggaagaagatgaaatggtgtccatcaccgggatgcgaatacgcggttgaatttggtgtaaatggaagtagtagttacgatgtttcttgtttgtgttcgtataagttttgctggaattgctgtgaagacgctcactctcctgtggattgtgaaacagtgtcaaagtggttactaaagaacaaggatgagtcggagaacatgaattggatacttgctaagacaaagccttgtcctaaatgcaagcgtcctattgagaagaacactggatgtaaccatatgtcatgctcagctccatgtagacattatttttgttgggcatgccttcaaccattgagcgatcacaaggcttgcaacgcgtttaaagcagacaatgaggatgaaactaagagaaaaagggctaaagatgcgatcgatagatacacgcatttttatgaaagatgggcattcaatcaatcctcgaggcttaaagctatgagtgatttggagaaatggcaatcggtggagcttaagcagcttagtgacattcagagcacaccagaaactcagctcagtttcaccgtagatgcatggcttcaggttagtaaaagtaacatttacaagaccattgaaaatgtttgtggaaacgacggaacataa

SEQ ID NO: 546 - protein, 432 aa, Arabidopsis thaliana
  G1773
MSSSDRDIIDIESGEEDLYSDGGNDIIDIESGEEDLYSDGGNVSDDYNPVDDTISRSEKSYVVVKEEDILKLQRDDIEQVSTVLSVSQVESIVLLLHYHWCVSKLEDEWFTDEERIRKTVGILKEPVVDVNGTEVDIQCGICFESYTRKEIARVSCGHPYCKTCWTGYITTKIEDGPGCLRVKCPEPSCYAVVGQDMIDEVTEKKDKDKYYRYFLRSYVEDGKKMKWCPSPGCEYAVEFGVNGSSSYDVSCLCSYKFCWNCCEDAHSPVDCETVSKWLLKNKDESENMNWILAKTKPCPKCKRPIEKNTGCNHMSCSAPCRHYFCWACLQPLSDHKACNAFKADNEDETKRKRAKDAIDRYTHFYERWAFNQSSRLKAMSDLEKWQSVELKQLSDIQSTPETQLSFTVDAWLQVSKSNIYKTIENVCGNDGT

SEQ ID NO: 547 - DNA, 969 bp, Arabidopsis thaliana
  G1835
atgattggaacaagcttccccgaggatcttgattgtggcaacttctttgacaacatggatgatctcatggactttcccggtggagatatcgatgtcggtttcggcataggtgactccgactctttccctaccatctggaccactcatcacgacacgtggcctgccgcttctgatcctctcttctcttccaacaccaactctgattcatcacctgagctctatgttccgtttgaggacattgttaaggtggaaagacctccaagctttgtagaggaaacattggttgagaagaaggaagattcgttttcgacaaacactgattcatcatcttctcatagccaattcaggagctcaagtccagtgtcggttctcgagagcagctcctcctcgtctcaaaccaccaacacaacctcccttgttctccctggaaagcacggtcgtccacgcacaaaacgccctcgtccacctgtccaggataaagatagagtcaaagacaatgtgtgcggtggtgactcgcgcctcatcattagaataccgaaacagtttctctctgatcacaacaagatgatcaacaagaagaagaagaagaaggccaagattacttcttcctcttcttcgtccgggattgatcttgaagtcaatggaaacaacgtcgattcgtattcttcagagcaatatccgcttaggaaatgtatgcactgtgaggtcaccaagactccacagtggaggcttggtccaatgggtccaaagacactttgcaatgcgtgcggtgtacgttacaaatcagggaggcttttcccggagtaccgtccagctgctagtccaacatttactccagctcttcactcaaactcacacaagaaagtggctgaaatgagaaacaagagatgcagtgatggtagctacataaccgaagagaatgatctgcaagggctgattccgaacaatgcctacattggcgtagactaa

SEQ ID NO: 548 - protein, 322 aa, Arabidopsis thaliana
  G1835
MIGTSFPEDLDCGNFFDNMDDLMDFPGGDIDVGFGIGDSDSFPTIWTTHHDTWPAASDPLFSSNTNSDSSPELYVPFEDIVKVERPPSFVEETLVEKKEDSFSTNTDSSSSHSQFRSSSPVSVLESSSSSSQTTNTTSLVLPGKHGRPRTKRPRPPVQDKDRVKDNVCGGDSRLIIRIPKQFLSDHNKMINKKKKKKAKITSSSSSSGIDLEVNGNNVDSYSSEQYPLRKCMHCEVTKTPQWRLGPMGPKTLCNACGVRYKSGRLFPEYRPAASPTFTPALHSNSHKKVAEMRNKRCSDGSYITEENDLQGLIPNNAYIGVD

SEQ ID NO: 549 - DNA, 1155 bp, Arabidopsis thaliana
  G1930
attcacattactaatctctcaagatttcacaattttcttgtgattttctctcagtttcttatttcgtttcataacatggatgccatgagtagcgtagacgagagctctacaactacagattccattccggcgagaaagtcatcgtctccggcgagtttactatatagaatgggaagcggaacaagcgtggtacttgattcagagaacggtgtcgaagtcgaagtcgaagccgaatcaagaaagcttccttcttcaagattcaaaggtgttgttcctcaaccaaatggaagatggggagctcagatttacgagaaacatcaacgcgtgtggcttggtactttcaacgaggaagacgaagcagctcgtgcttacgacgtcgcggctcaccgtttccgtggccgcgatgccgttactaatttcaaagacacgacgttcgaagaagaggttgagttcttaaacgcgcattcgaaatcagagatcgtagatatgttgagaaaacacacttacaaagaagagttagaccaaaggaaacgtaaccgtgacggtaacggaaaagagacgacggcgtttgctttggcttcgatggtggttatgacggggtttaaaacggcggagttactgtttgagaaaacggtaacgccaagtgacgtcgggaaactaaaccgtttagttataccaaaacaccaagcggagaaacattttccgttaccgttaggtaataataacgtctccgttaaaggtatgctgttgaatttcgaagacgttaacgggaaagtgtggaggttccgttactcttattggaatagtagtcaaagttatgtgttgaccaaaggttggagtagattcgttaaagagaagagactttgtgctggtgatttgatcagttttaaaagatccaacgatcaagatcaaaaattctttatcgggtggaaatcgaaatccgggttggatctagagacgggtcgggttatgagattgtttggggttgatatttctttaaacgccgtcgttgtagtgaaggaaacaacggaggtgttaatgtcgtcgttaaggtgtaagaagcaacgagttttgtaataacaatttaacaacttgggaaagaaaaaaaagctttttgattttaatttctcttcaacgttaatcttgctgagatta

SEQ ID NO: 550 - protein, 333 aa, Arabidopsis thaliana
  G1930
MDAMSSVDESSTTTDSIPARKSSSPASLLYRMGSGTSVVLDSENGVEVEVEAESRKLPSSRFKGVVPQPNGRWGAQIYEKHQRVWLGTFNEEDEAARAYDVAAHRFRGRDAVTNFKDTTFEEEVEFLNAHSKSEIVDMLRKHTYKEELDQRKRNRDGNGKETTAFALASMVVMTGFKTAELLFEKTVTPSDVGKLNRLVIPKHQAEKHFPLPLGNNNVSVKGMLLNFEDVNGKVWRFRYSYWNSSQSYVLTKGWSRFVKEKRLCAGDLISFKRSNDQDQKFFIGWKSKSGLDLETGRVMRLFGVDISLNAVVVVKETTEVLMSSLRCKKQRVL

SEQ ID NO: 551 - DNA, 1307 bp, Arabidopsis thaliana
  G2057
gccgtctcgacgaatatgctctaccaatgtctgacgaccaattccatcacccgccgcctccttcttcaatgaggcaccgttctacgtcggatgcggcggacggcggctgcggcgagattgttgaggtgcaaggtggtcacattgttcggtctaccggaagaaaagaccgccacagcaaagtctgcacggctaaagggccacgtgaccggcgcgtgagactctctgctcacacggcgattcagttttacgatgttcaagacaggcttggtttcgaccgacctagcaaagccgttgattggcttatcaaaaaggctaagacttccattgacgagctcgctgagcttcctccctggaatcccgccgatgcaattcgcctagccgctgctaacgctaaacccagaagaaccaccgccaaaacccaaatctctccgtctccgccaccgccgcaacagcaacaacaacaacaacagcttcagttcggtgttggcttcaacggaggaggagcagagcatccgagtaacaacgagtcgagttttctcccgccgtcaatggattcagattcgatagctgacactataaagtcgttttttccggtgattggctcttcaacggaggctccttcgaatcataaccttatgcacaactatcatcatcagcatccgccggatttgctttctcgaactaatagccaaaaccaagatctccgtctctcgctgcaatcgttcccggatggtccaccgtcgcttctgcaccaccaacatcaccaccacacctctgcttccgcctccgagcctactctgttctacggacagagcaatccgttagggtttgacacatcgagttgggagcagcagtcgtcggaattcggaaggattcagagactagtggcttggaacagcggcggtggcggcggagcaaccgatacaggaaacggaggagggtttctgttcgctcctcctactccttcaacgacgtcgtttcagccagttcttggccaaagccaacagctttattctcagaggggtccccttcagtccagttacagtcccatgatccgtgcttggtttgatcctcaccatcatcaccaatccatctccaccgacgatctcaaccaccaccatcaccttcctccaccggttcaccaatcagcaatccccggaatcggattcgcctcaggtgaattctcttcgggttttcgcataccagcacggtttcagggccaagaagaggagcagcacgacggtctcactcacaagccgtcctctgcttcctctatttctcgccattgacaatcgaaactaatcctc

SEQ ID NO: 552 - protein, 420 aa, Arabidopsis thaliana
  G2057
MSDDQFHHPPPPSSMRHRSTSDAADGGCGEIVEVQGGHIVRSTGRKDRHSKVCTAKGPRDRRVRLSAHTAIQFYDVQDRLGFDRPSKAVDWLIKKAKTSIDELAELPPWNPADAIRLAAANAKPRRTTAKTQISPSPPPPQQQQQQQQLQFGVGFNGGGAEHPSNNESSFLPPSMDSDSIADTIKSFFPVIGSSTEAPSNHNLMHNYHHQHPPDLLSRTNSQNQDLRLSLQSFPDGPPSLLHHQHHHHTSASASEPTLFYGQSNPLGFDTSSWEQQSSEFGRIQRLVAWNSGGGGGATDTGNGGGFLFAPPTPSTTSFQPVLGQSQQLYSQRGPLQSSYSPMIRAWFDPHHHHQSISTDDLNHHHHLPPPVHQSAIPGIGFASGEFSSGFRIPARFQGQEEEQHDGLTHKPSSASSISRH

SEQ ID NO: 553 - DNA, 1456 bp, Arabidopsis thaliana
  G2144
attagggttttgttgtcgtgagatttgattacacaaattgctgaatttggtttcgattattggtgttattgttttcgaagatttccagtgagtttccgtttatggatctgactggaggatttggagctagatccggcggtgttggaccgtgccgggaaccaataggccttgaatcgctacatctcggtgacgaatttcggcaactagtgacgactttacctcccgagaaccccggcggttcgttcacggctttgcttgagcttccacctacacaagcagtggagcttctccatttcactgattcttcgtcttctcaacaagcggcagtgacagggatcggtggagagattcctccgccgcttcactctttcggtgggacattggcttttccttctaactcagttctcatggagcgagcagctcgtttctcggtgattgccactgagcaacaaaacggaaatatctccggggagactccgacgagctctgtaccttccaattcaagtgctaatctcgacagagtcaagacggagcctgctgagaccgattcatctcagcggttgatttctgattcagcgattgagaatcaaatcccttgccctaaccagaacaatcgaaatgggaagaggaaagatttcgaaaagaagggtaaaagctcgacgaagaagaacaaaagctctgaagagaacgagaagctgccatatgttcacgttagagctcgtcgtggtcaagcaaccgatagccatagcttagcagaacgagcaagaagagagaagataaatgcacgaatgaagctgttacaggaactggtcccaggctgtgataagattcaaggtaccgcgctggtgctggatgaaatcattaaccatgtccagtcattacaacgtcaagtggagatgctatcaatgagacttgctgcggtaaaccccagaatcgacttcaatctcgacaccatattggcttcagaaaacggttctttaatggatgggagcttcaatgccgcaccaatgcagcttgcttggcctcagcaagccattgagaccgaacagtcctttcatcaccggcaactgcaacaaccaccaacacaacaatggccttttgacggcttgaaccagccggtatggggaagagaagaggatcaagctcatggcaatgataacagcaatttgatggcagtttctgaaaatgtaatggtggcttctgctaatttgcacccaaatcaggtcaaaatggagctgtaagttgggaaaacggtagagatcatgaatgtgtatatacatcgtataagctcgtttctctctatataaatataatcataaatatagatatctgttaagaaggtatcagtcatttgattcagagagacaacactggtatgattgtttcttattcttgtaccagatttcgacaatgtagaatttagtaggatatgatcattttgatctcgttatatata

SEQ ID NO: 554 - protein, 379 aa, Arabidopsis thaliana
  G2144
MDLTGGFGARSGGVGPCREPIGLESLHLGDEFRQLVTTLPPENPGGSFTALLELPPTQAVELLHFTDSSSSQQAAVTGIGGEIPPPLHSFGGTLAFPSNSVLMERAARFSVIATEQQNGNISGETPTSSVPSNSSANLDRVKTEPAETDSSQRLISDSAIENQIPCPNQNNRNGKRKDFEKKGKSSTKKNKSSEENEKLPYVHVRARRGQATDSHSLAERARREKINARMKLLQELVPGCDKIQGTALVLDEIINHVQSLQRQVEMLSMRLAAVNPRIDFNLDTILASENGSLMDGSFNAAPMQLAWPQQAIETEQSFHHRQLQQPPTQQWPFDGLNQPVWGREEDQAHGNDNSNLMAVSENVMVASANLHPNQVKMEL

SEQ ID NO: 555 - DNA, 777 bp, Arabidopsis thaliana
  G2145
atggacgtttttgttgatggtgaattggagtctctcttggggatgttcaactttgatcaatgttcatcatctaaagaggagagaccgcgagacgagttgcttggcctctctagcctttacaatggtcatcttcatcaacatcaacaccataacaatgtcttatcttctgatcatcatgctttcttgctccctgatatgttcccatttggtgcaatgccgggaggaaatcttccggccatgcttgattcttgggatcaaagtcatcacctccaagaaacgtcttctcttaagaggaaactacttgacgtggagaatctatgcaaaactaactctaactgtgacgtcacaagacaagagcttgcgaaatccaagaaaaaacagagggtaagctcggaaagcaatacagttgacgagagcaacactaattgggtagatggtcagagtttaagcaacagttcagatgatgagaaagcttcggtcacaagtgttaaaggcaaaactagagccaccaaagggacagccactgatcctcaaagcctttatgctcggaaacgaagagagaagattaacgaaaggctcaagacactacaaaaccttgtgccaaacgggacaaaagtcgatataagcacgatgcttgaagaagcggtccattacgtgaagttcttgcagcttcagattaagttgttgagctcggatgatctatggatgtacgcaccattggcttacaacggcctggacatggggttccatcacaaccttttgtctcggcttatgtga

SEQ ID NO: 556 - protein, 258 aa, Arabidopsis thaliana
  G2145
MDVFVDGELESLLGMFNFDQCSSSKEERPRDELLGLSSLYNGHLHQHQHHNNVLSSDHHAFLLPDMFPFGAMPGGNLPAMLDSWDQSHHLQETSSLKRKLLDVENLCKTNSNCDVTRQELAKSKKKQRVSSESNTVDESNTNWVDGQSLSNSSDDEKASVTSVKGKTRATKGTATDPQSLYARKRREKINERLKTLQNLVPNGTKVDISTMLEEAVHYVKFLQLQIKLLSSDDLWMYAPLAYNGLDMGFHHNLLSRLM

SEQ ID NO: 557 - DNA, 962 bp, Arabidopsis thaliana
  G2295
gtaatatataacaataactcaggttacaaaggatggttccgaaagtggtcgacctacaaaggatagcgaacgataagacaaggataacaacttacaagaagaggaaagctagtctttacaagaaggcacaagagttctcaactctctgcggcgtcgagacatgtctcatcgtctacggtcccacgaaggctaccgatgtggtgatttccgagccagagatatggccgaaggacgagaccaaagtcagggccatcatacgcaagtacaaagacacagtgtcgaccagctgcaggaaagaaaccaacgtggagactttcgtcaacgatgtagggaaaggaaacgaggtggtgactaaaaagagagtgaagcgtgagaataagtattctagttgggaggagaagctagacaagtgttcacgagagcaactacatgggattttctgtgccgtggatagcaagttaaatgaagctgtaacgagacaggagcgtagtatgtttagggttaatcatcaagccatggacacaccattcccgcagaatttaatggaccaacaattcatgccacagtattttcatgagcagccacagtttcaaggcttccctaataatttcaataatatgggtttctcgttgatttcacctcatgatggtcagattcaaatggacccaaatctcatggagaagtggaccgacttggctttgactcaaagcttgatgatgtcaaagggaaacgatggtactcaattcatgcagaggcaagaacaaccatactataatcgtgaacaggttgtatcgaggtctgcaggtttcaatgttaacccgtttatgggatatcaagtcccgtttaatattcctaattggagattatcgggaaatcaagttgaaaattgggagctttcagggaagaaaacgatatgatttgaattacggagctttattagtttttagggttttatagttttg

SEQ ID NO: 558 - protein, 294 aa, Arabidopsis thaliana
  G2295
MVPKVVDLQRIANDKTRITTYKKRKASLYKKAQEFSTLCGVETCLIVYGPTKATDVVISEPEIWPKDETKVRAIIRKYKDTVSTSCRKETNVETFVNDVGKGNEVVTKKRVKRENKYSSWEEKLDKCSREQLHGIFCAVDSKLNEAVTRQERSMFRVNHQAMDTPFPQNLMDQQFMPQYFHEQPQFQGFPNNFNNMGFSLISPHDGQIQMDPNLMEKWTDLALTQSLMMSKGNDGTQFMQRQEQPYYNREQVVSRSAGFNVNPFMGYQVPFNIPNWRLSGNQVENWELSGKKTI

SEQ ID NO: 559 - DNA, 832 bp, Arabidopsis thaliana
  G2512
aacttagtgccacttagacacaataagaaaaccgttaacaagaagaaaaaaaaaagatcgaaaatggaatatcaaactaacttcttaagtggagagttttccccggagaactcttcttcaagctcatggagctcacaagaatcattcttgtgggaagagagtttcttacatcaatcatttgaccaatccttccttttatctagccctactgataactactgtgatgacttctttgcatttgaatcatcaatcataaaagaagaaggaaaagaagccaccgtggcggccgaggaggaggagaagtcatacagaggagtgaggaaacggccgtgggggaaattcgcggccgagataagagactcaacgaggaaagggataagagtgtggcttgggacattcgacaccgcggaggcggcggctctcgcttatgatcaggcggctttcgctttgaaaggcagcctcgcagtactcaatttccccgcggatgtcgttgaagaatctctccggaagatggagaatgtgaatctcaatgatggagagtctccggtgatagccttgaagagaaaacactccatgagaaaccgtcctagaggaaagaagaaatcttcttcttcttcgacgttgacatcttctccttcttcctcctcctcctattcatcttcttcgtcttcttcttctttgtcgtcaagaagtagaaaacagagtgttgttatgacgcaagaaagtaatacaacacttgtggttcttgaggatttaggtgctgaatacttagaagagcttatgagatcatgttcttgataatctctgcttctacaatttttatgtaatttga

SEQ ID NO: 560 - protein, 244 aa, Arabidopsis thaliana
  G2512
MEYQTNFLSGEFSPENSSSSSWSSQESFLWEESFLHQSFDQSFLLSSPTDNYCDDFFAFESSIIKEEGKEATVAAEEEEKSYRGVRKRPWGKFAAEIRDSTRKGIRVWLGTFDTAEAAALAYDQAAFALKGSLAVLNFPADVVEESLRKMENVNLNDGESPVIALKRKHSMRNRPRGKKKSSSSSTLTSSPSSSSSYSSSSSSSSLSSRSRKQSVVMTQESNTTLVVLEDLGAEYLEELMRSCS

SEQ ID NO: 561 - DNA, 945 bp, Arabidopsis thaliana
  G2531
atgagttggtgtgatggttcagatgataactacgatcttaatcttgaaagagtatcgaacactgatcatccatcggttcaactcaaagaccaatctcaatcatgtgtaacgagccgtccagattccaagattagcgctgaaactcccatcacgacttgtccttcttgcggacacaagctccatcatcaccaagacgaccaggttggtagcatcaaagatttaccaagcttaccggcaggagtcaaattcgatccgtcggataaagagatccttatgcatttggaggcgaaggtatcatccgataagcgaaaacttcatccgttgattgatgaatttatacctacgcttgaaggagagaatggaatttgttatacgcatcctgagaaacttcctggagtaagcaaggacgggcaagtacggcacttcttccaccggccatcaaaggcttatacgaccggaacacgaaaacgaagaaaagtgagcacagatgaggaaggccatgaaacaaggtggcacaaaacaggcaagactcgacctgttttgtctcaatcaggagaaaccggtttcaagaagatcctagtgctctacaccaactatggtcgccagaagaagcctgagaagacgaattgggtgatgcatcagtatcatttaggtagcagcgaggacgaaaaagacggtgaaccagtcctctctaaagtcttctaccaaacacagcctaggcaatgcggttcgatggaacctaaaccgaaaaatctcgtaaacctaaaccggtttagttatgaaaatattcaggccggtttcgggtatgagcatggtggtaaaagtgaagagacgacgcaggtgattcgagagttggtagttcgtgaaggcgatgggtcatgttcgtttcttagttttacttgtgatgcaagtaagggtaaagaaagcttcatgaagaatcaatag

SEQ ID NO: 562 - protein, 314 aa, Arabidopsis thaliana
  G2531
MSWCDGSDDNYDLNLERVSNTDHPSVQLKDQSQSCVTSRPDSKISAETPITTCPSCGHKLHHHQDDQVGSIKDLPSLPAGVKFDPSDKEILMHLEAKVSSDKRKLHPLIDEFIPTLEGENGICYTHPEKLPGVSKDGQVRHFFHRPSKAYTTGTRKRRKVSTDEEGHETRWHKTGKTRPVLSQSGETGFKKILVLYTNYGRQKKPEKTNWVMHQYHLGSSEDEKDGEPVLSKVFYQTQPRQCGSMEPKPKNLVNLNRFSYENIQAGFGYEHGGKSEETTQVIRELVVREGDGSCSFLSFTCDASKGKESFMKNQ

SEQ ID NO: 563 - DNA, 1005 bp, Arabidopsis thaliana
  G2535
atgaacatatcagtaaacggacagtcacaagtacctcctggctttaggtttcacccaaccgaggaagagctcttgaagtattacctccgcaagaaaatctctaacatcaagatcgatctcgatgttattcctgacattgatctcaacaagctcgagccttgggatattcaagagatgtgtaagattggaacgacgccgcaaaacgattggtacttttatagccataaggacaagaagtatcccaccgggactagaaccaacagagccaccacggtcggattttggaaagcgacgggacgtgacaagaccatatataccaatggtgatagaatcgggatgcgaaagacgcttgtcttctacaaaggtcgagcccctcatggtcagaaatccgattggatcatgcacgaatatagactcgacgagagtgtattaatctcctcgtgtggcgatcatgacgtcaacgtagaaacgtgtgatgtcataggaagtgacgaaggatgggtggtgtgtcgtgttttcaagaaaaataacctttgcaaaaacatgattagtagtagcccggcgagttcggtgaaaacgccgtcgttcaatgaggagactatcgagcaacttctcgaagttatggggcaatcttgtaaaggagagatagttttagaccctttcttaaaactccctaacctcgaatgccataacaacaccaccatcacgagttatcagtggttaatcgacgaccaagtcaacaactgccacgtcagcaaagttatggatcccagcttcatcactagctgggccgctttggatcggctcgttgcctcacagttaaatgggcccaactcgtattcaataccagccgttaatgagacttcacaatcaccgtatcatggactgaaccggtccggttgtaataccggtttaacaccagattactatataccggagattgatttatggaacgaggcagatttcgcgagaacgacatgccacttgttgaacggtagtggataa

SEQ ID NO: 564 - protein, 334 aa, Arabidopsis thaliana
  G2535
MNISVNGQSQVPPGFRFHPTEEELLKYYLRKKISNIKIDLDVIPDIDLNKLEPWDIQEMCKIGTTPQNDWYFYSHKDKKYPTGTRTNRATTVGFWKATGRDKTIYTNGDRIGMRKTLVFYKGRAPHGQKSDWIMHEYRLDESVLISSCGDHDVNVETCDVIGSDEGWVVCRVFKKNNLCKNMISSSPASSVKTPSFNEETIEQLLEVMGQSCKGEIVLDPFLKLPNLECHNNTTITSYQWLIDDQVNNCHVSKVMDPSFITSWAALDRLVASQLNGPNSYSIPAVNETSQSPYHGLNRSGCNTGLTPDYYIPEIDLWNEADFARTTCHLLNGSG

SEQ ID NO: 565 - DNA, 1099 bp, Arabidopsis thaliana
  G2590
cacacaccaaagaaaagaaaaacaaagataatgaggtcgaaaattaagttatcactcatagctaataagacctcaaggagaaccacattcaggaagaggaagggagggataacgaacaaactccatgagctaacaactctctgcggcgtcaaagcatgtgcggtaatctccagtccgtacgagaatccagtggtgtggccgtcaaccgaaggtgttcaagaggcggtttccatgtttatggagaggccggcgacagaacaatccaagctgatgatgagtcatgagacctacttgcaggacaaaattaccaaagaaacaaagaaactggagagtctacgtcgtgaaaaccgagaatctcagcttaggcaatttatgtttgattgtgttgaaggtaagatgagtgagcatcagtatggtgcaagggaccttcaagatttaagtctttatattgatcactatatcaatcagcttaattcaagtgtcatgctccttacaaacaatggtgcgtcttcttcttcctttcctcctccgcttcatacttcagttgcgggtgcgggtgcgggtgcgggtgctgctcctcttgttgttgcgggtgcgggtgcggctcctcttgctgttgcgggggcgggtgcgagtcctcttgctgttgcgggtgtgggtgcggctcctcttgctgttgcgggtgccggtcctcctatggctcagaatcagtatgagccgattcagccctatatccctactgcttttagtgataatattcaataccaagctcctgtggattttaatcatcagatccaacatggaatctatgataatctcagtttggatccaaatcatcagtatccgtttcaagatgatccattcatggagatgttgatggaatatccttatgaacaagtgggttatgctgcagagcatgcacacatccctttcatgaacggaaactactacaactaccaccaaccaccaaccgttggtcttactaccaccggtcacatgccttccaacaacgccaccaccaccaccaccaccaacaccaccgttgtgtgatgtgtttcagtagtttgcatttgtgttttgtccatttcaaaagaccaat

SEQ ID NO: 566 - protein, 339 aa, Arabidopsis thaliana
  G2590
MRSKIKLSLIANKTSRRTTFRKRKGGITNKLHELTTLCGVKACAVISSPYENPVVWPSTEGVQEAVSMFMERPATEQSKLMMSHETYLQDKITKETKKLESLRRENRESQLRQFMFDCVEGKMSEHQYGARDLQDLSLYIDHYINQLNSSVMLLTNNGASSSSFPPPLHTSVAGAGAGAGAAPLVVAGAGAAPLAVAGAGASPLAVAGVGAAPLAVAGAGPPMAQNQYEPIQPYIPTAFSDNIQYQAPVDFNHQIQHGIYDNLSLDPNHQYPFQDDPFMEMLMEYPYEQVGYAAEHAHIPFMNGNYYNYHQPPTVGLTTTGHMPSNNATTTTTTNTTVV

SEQ ID NO: 567 - DNA, 1200 bp, Arabidopsis thaliana
  G2719
atggaaggagaaactcatcaatcggagccgttacctttagcatctggagattccgatgaagggatcagtgctgcgattgaggcggagcttgctgagttagctgctggagattcaagcggcggtggtggttgcggcggcggaggaggagggattaggagtaaagtcaaaggaccttggtctacggaggaagacgcggttcttacgaagcttgtgaggaaactaggaccgaggaattggagtttgatcgctcgtggaatccctggtcgttctggtaaatcttgtcgattgcgttggtgtaatcagcttgacccttgtctcaagcgtaaacctttctctgatgaggaagatcgtatgataatttctgctcacgcggttcacggaaacaaatgggcagtgattgcgaaactgttaactggaagaacagataacgctatcaagaaccattggaactcaactcttagacgtaaatacgcagatctatggaataatggtcaatggatggctaattcagttactaccgcttccgtcaaaaacgaaaatgtcgatgaaacaactaatcctccatcctcaaaacaacagttgcctcaaggagatatcaattcctccccgccaaagcctccacaagtgagtgatgttgtaatggaagaggcagctaatgaacctcaagaacctcaagaacaacaagaacaagctccaccggtagtgagtaacgttccaacagaaaataacgtgtttcgccccgtggctcgcgttggtgcattcagtatctataacccaaccagccagaaaaatggttacagagactacaatatagttccatgtgagggaccgttgattcaagcagctaaacccgattcattggctggtaaatttctacaatctctttgtgatgaacctcaaatcccgtcaaaatgtggtcacggctgctctactcttccagctgaaactaagttctcacgtaactcggtgttgggacctgagtttgtggattatgaagagccttctgcggttttcaaccaagaactaatatctatagcaaccgatttgaacaacattgcatggataaagagtggccttgacaatgctgttgtcagagaagcagaacagagtttgaagatggataattacaattataatgatcctcgaatcaagtttactggaatgatgcctagacaagatttcttctgtgcaagaagctga

SEQ ID NO: 568 - protein, 399 aa, Arabidopsis thaliana
  G2719
MEGETHQSEPLPLASGDSDEGISAAIEAELAELAAGDSSGGGGCGGGGGGIRSKVKGPWSTEEDAVLTKLVRKLGPRNWSLIARGIPGRSGKSCRLRWCNQLDPCLKRKPFSDEEDRMIISAHAVHGNKWAVIAKLLTGRTDNAIKNHWNSTLRRKYADLWNNGQWMANSVTTASVKNENVDETTNPPSSKQQLPQGDINSSPPKPPQVSDVVMEEAANEPQEPQEQQEQAPPVVSNVPTENNVFRPVARVGAFSIYNPTSQKNGYRDYNIVPCEGPLIQAAKPDSLAGKFLQSLCDEPQIPSKCGHGCSTLPAETKFSRNSVLGPEFVDYEEPSAVFNQELISIATDLNNIAWIKSGLDNAVVREAEQSLKMDNYNYNDPRIKFTGMMPRQDFFCARS

SEQ ID NO: 569 - DNA, 1246 bp, Arabidopsis thaliana
  G9
gtgtttcttctttctgctaaaaggttataatttttgtttcttggtttggtgagaatcttcaagaaactgaaacaaagaaaatggattctagttgcatagacgagataagttcctccacttcagaatctttctccgccaccaccgccaagaagctctctcctcctcccgcggcggcgttacgcctctaccggatgggaagcggcgggagcagcgtcgtgttggatcccgagaacggcctagagacggagtcacgaaagctaccatcttcaaaatacaaaggtgttgttcctcagcctaacggaagatggggagctcagatctacgagaagcaccaacgagtatggctcgggactttcaacgagcaagaagaagctgctcgttcctacgacatcgcagcttgtagattccgtggccgcgacgccgtcgtcaacttcaagaacgttctggaagacggcgatttagcttttcttgaagctcactcaaaggccgagatcgtcgacatgttgagaaaacacacttacgccgacgagcttgaacagaacaataaacggcagttgtttctctccgtcgacgctaacggaaaacgtaacggatcgagtactactcaaaacgacaaagttttaaagacgcgtgaagttcttttcgagaaggctgttacacctagcgacgttgggaagctaaaccgtctcgtgatacctaaacaacacgccgagaaacactttccgttaccgtcaccgtcaccggcagtgactaaaggagttttgatcaacttcgaagacgttaacggtaaagtgtggaggttccgttactcatactggaacagtagtcaaagttacgtgttgaccaagggatggagtcgattcgtcaaggagaagaatcttcgagccggtgatgttgttactttcgagagatcgaccggactagagcggcagttatatattgattggaaagttcggtctggtccgagagaaaacccggttcaggtggtggttcggcttttcggagttgatatctttaatgtgaccaccgtgaagccaaacgacgtcgtggccgtttgcggtggaaagagatctcgagatgttgatgatatgtttgcgttacggtgttccaagaagcaggcgataatcaatgctttgtgacatatttccttttccgattttatgctttcgttttttaatttttttttttgtcaagttgtgtaggttgtgattcatgctaggttgtatttaggaaaagagataagacc

SEQ ID NO: 570 - protein, 352 aa, Arabidopsis thaliana
  G9
MDSSCIDEISSSTSESFSATTAKKLSPPPAAALRLYRMGSGGSSVVLDPENGLETESRKLPSSKYKGVVPQPNGRWGAQIYEKHQRVWLGTFNEQEEAARSYDIAACRFRGRDAVVNFKNVLEDGDLAFLEAHSKAEIVDMLRKHTYADELEQNNKRQLFLSVDANGKRNGSSTTQNDKVLKTREVLFEKAVTPSDVGKLNRLVIPKQHAEKHFPLPSPSPAVTKGVLINFEDVNGKVWRFRYSYWNSSQSYVLTKGWSRFVKEKNLRAGDVVTFERSTGLERQLYIDWKVRSGPRENPVQVVVRLFGVDIFNVTTVKPNDVVAVCGGKRSRDVDDMFALRCSKKQAIINAL

SEQ ID NO: 571 - DNA, 831 bp, Arabidopsis thaliana
  G12
gtgtcggtgaattttttgaaacttcttctcttttgcggtttcgtgttccactcctctcttcttggcccacgtgttcatcaatctctccctccgcatgtaatcgcttcgccgtcaatatcacatctttcttcttctttatctttaaaatctctttagatcgattcttttgtggattcttgaaatctccggagaaaaccactatggagacggcgactgaagtggccacggtggtgtcaactccggcggttacggttgcggcggtggcgacgaggaagagagataagccgtataaagggataaggatgaggaagtgggggaagtgggtggcggagataagagagcctaataaaaggtcaaggatctggcttggctcttactctactcctgaagcggcggcgcgtgcttacgacacggcggtgttttatctccgaggtccttctgctcggcttaacttcccggagcttttagccggagtgacggtgacgggaggaggcggaggaggagtgaacggtggtggagatatgtcggcggcgtatataaggagaaaagcggcggaggttggagcacaagtggatgcgttagaagcggcgggggcgggagggaatcgtcatcatcatcatcatcaacatcaacgtggtaatcatgattacgtagataatcatagtgattatcgtattaatgatgatcttatggagtgtagtagtaaagaagggtttaagaggtgtaatggatcgttggaacgggttgatttaaacaaattacccgatccggaaacttcagatgacgattaggaaagcaaaaaatagaaacaaaaaaaaaaaaaaaaaaaaa

SEQ ID NO: 572 - protein, 196 aa, Arabidopsis thaliana
  G12
METATEVATVVSTPAVTVAAVATRKRDKPYKGIRMRKWGKWVAEIREPNKRSRIWLGSYSTPEAAARAYDTAVFYLRGPSARLNFPELLAGVTVTGGGGGGVNGGGDMSAAYIRRKAAEVGAQVDALEAAGAGGNRHHHHHQHQRGNHDYVDNHSDYRINDDLMECSSKEGFKRCNGSLERVDLNKLPDPETSDDD

SEQ ID NO: 573 - DNA, 929 bp, Arabidopsis thaliana
  G40
cttgaaaaagaatctacctgaaaagaaaaaaaagagagagagatataaatagctttaccaagacagatatactatcttttattaatccaaaaagactgagaactctagtaactacgtactacttaaaccttatccagtttcttgaaacagagtactctgatcaatgaactcattttcagctttttctgaaatgtttggctccgattacgagcctcaaggcggagattattgtccgacgttggccacgagttgtccgaagaaaccggcgggccgtaagaagtttcgtgagactcgtcacccaatttacagaggagttcgtcaaagaaactccggtaagtgggtttctgaagtgagagagccaaacaagaaaaccaggatttggctcgggactttccaaaccgctgagatggcagctcgtgctcacgacgtcgctgcattagccctccgtggccgatcagcatgtctcaacttcgctgactcggcttggcggctacgaatcccggagtcaacatgcgccaaggatatccaaaaagcggctgctgaagcggcgttggcttttcaagatgagacgtgtgatacgacgaccacgaatcatggcctggacatggaggagacgatggtggaagctatttatacaccggaacagagcgaaggtgcgttttatatggatgaggagacaatgtttgggatgccgactttgttggataatatggctgaaggcatgcttttaccgccgccgtctgttcaatggaatcataattatgacggcgaaggagatggtgacgtgtcgctttggagttactaatattcgatagtcgtttccatttttgtactatagtttgaaaatattctagttcctttttttagaatggttccttcattttattttattttattgttgtagaaacgagtggaaaataattcaatac

SEQ ID NO: 574 - protein, 213 aa, Arabidopsis thaliana
  G40
MNSFSAFSEMFGSDYEPQGGDYCPTLATSCPKKPAGRKKFRETRHPIYRGVRQRNSGKWVSEVREPNKKTRIWLGTFQTAEMAARAHDVAALALRGRSACLNFADSAWRLRIPESTCAKDIQKAAAEAALAFQDETCDTTTTNHGLDMEETMVEAIYTPEQSEGAFYMDEETMFGMPTLLDNMAEGMLLPPPSVQWNHNYDGEGDGDVSLWSY

SEQ ID NO: 575 - DNA, 803 bp, Arabidopsis thaliana
  G41
ctgatcaatgaactcattttctgccttttctgaaatgtttggctccgattacgagtctccggtttcctcaggcggtgattacagtccgaagcttgccacgagctgccccaagaaaccagcgggaaggaagaagtttcgtgagactcgtcacccaatttacagaggagttcgtcaaagaaactccggtaagtgggtgtgtgagttgagagagccaaacaagaaaacgaggatttggctcgggactttccaaaccgctgagatggcagctcgtgctcacgacgtcgccgccatagctctccgtggcagatctgcctgtctcaatttcgctgactcggcttggcggctacgaatcccggaatcaacctgtgccaaggaaatccaaaaggcggcggctgaagccgcgttgaattttcaagatgagatgtgtcatatgacgacggatgctcatggtcttgacatggaggagaccttggtggaggctatttatacgccggaacagagccaagatgcgttttatatggatgaagaggcgatgttggggatgtctagtttgttggataacatggccgaagggatgcttttaccgtcgccgtcggttcaatggaactataattttgatgtcgagggagatgatgacgtgtccttatggagctattaaaattcgatttttatttccatttttggtattatagctttttatacatttgatccttttttagaatggatcttcttctttttttggttgtgagaaacgaatgtaaatggtaaaagttgttgtcaaatgcaaatgtttttgagtgcag

SEQ ID NO: 576 - protein, 207 aa, Arabidopsis thaliana
  G41
MFGSDYESPVSSGGDYSPKLATSCPKKPAGRKKFRETRHPIYRGVRQRNSGKWVCELREPNKKTRIWLGTFQTAEMAARAHDVAAIALRGRSACLNFADSAWRLRIPESTCAKEIQKAAAEAALNFQDEMCHMTTDAHGLDMEETLVEAIYTPEQSQDAFYMDEEAMLGMSSLLDNMAEGMLLPSPSVQWNYNFDVEGDDDVSLWSY

SEQ ID NO: 577 - DNA, 908 bp, Arabidopsis thaliana
  misc_feature (851)..(851): n is a, c, g, or t
  G42
cctgaactagaacagaaagagagagaaactattatttcagcaaaccataccaacaaaaaagacagagatcttttagttaccttatccagtttcttgaaacagagtactcttctgatcaatgaactcattttctgctttttctgaaatgtttggctccgattacgagtcttcggtttcctcaggcggtgattatattccgacgcttgcgagcagctgccccaagaaaccggcgggtcgtaagaagtttcgtgagactcgtcacccaatatacagaggagttcgtcggagaaactccggtaagtgggtttgtgaggttagagaaccaaacaagaaaacaaggatttggctcggaacatttcaaaccgctgagatggcagctcgagctcacgacgttgccgctttagcccttcgtggccgatcagcctgtctcaatttcgctgactcggcttggagactccgaatcccggaatcaacttgcgctaaggacatccaaaaggcggcggctgaagctgcgttggcgtttcaggatgagatgtgtgatgcgacgacggatcatggcttcgacatggaggagacgttggtggaggctatttacacggcggaacagagcgaaaatgcgttttatatgcacgatgaggcgatgtttgagatgccgagtttgttggctaatatggcagaagggatgcttttgccgcttccgtccgtacagtggaatcataatcatgaagtcgacggcgatgatgacgacgtatcgttatggagttattaaaactcagattattatttccatttttagtacgatactttttattttattattatttttagatccttttttagaatggaatctncattatgtttgtaaaactgagaaacgagtgtaaattaaattgattcagtttcagtat

SEQ ID NO: 578 - protein, 216 aa, Arabidopsis thaliana
  G42
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWSY

SEQ ID NO: 579 - DNA, 1107 bp, Arabidopsis thaliana
  G170
atggggatgaagaaggtgaagctatctttgatagctaatgaaagatcaaggaaaacatccttcataaagaggaaagacgggatttttaagaaactccacgagttgtcaactctgtgtggtgtccaagcttgtgctctcatctacagtccattcataccggttccagagtcatggccgtcaagggaaggtgctaaaaaggtggcttcaaggtttctggagatgccgccgacagcccgaaccaagaagatgatggatcaagagacttaccttatggagaggattaccaaagcaaaagagcaactaaagaacctggctgctgagaaccgagagttacaggttagacgatttatgtttgattgtgttgaaggcaaaatgtcccagtatcattatgatgcaaaagaccttcaagatttgcaatcttgtataaatctatatctcgatcagcttaacggaaggatcgagtccattaaagaaaatggtgagtcgttgttgtcttccgtctctccttttcctactagaattggtgttgacgaaattggtgatgagtcattttccgactctcctattcatgctacaactggggttgtagatactcttaatgctaccaatcctcatgttcttacgggcgatatgactccttttcttgatgcggacgcaactgcggtaactgcttccagtagattttttgatcatattccatatgaaaatatgaatatgagtcaaaatctgcatgaaccgtttcaacaccttgttcctactaacgtttgtgatttttttcaaaatcagaatatgaatcaggttcaataccaggctcctaataatctgtttaatcagattcaacgagaattctacaacataaatttgaatctgaatttgaatctgaattcgaatcagtatctgaatcaacaacaatcattcatgaatccgatggtggaacaacatatgaatcatgttggagggcgtgaaagcattcctttcgtggacggaaactgctacaactaccatcaactaccatccaatcaactaccagccgttgatcatgcttccaccagttacatgccttccaccaccggtgtctatgatccttacatcaacaataatctctaa

SEQ ID NO: 580 - protein, 368 aa, Arabidopsis thaliana
  G170
MGMKKVKLSLIANERSRKTSFIKRKDGIFKKLHELSTLCGVQACALIYSPFIPVPESWPSREGAKKVASRFLEMPPTARTKKMMDQETYLMERITKAKEQLKNLAAENRELQVRRFMFDCVEGKMSQYHYDAKDLQDLQSCINLYLDQLNGRIESIKENGESLLSSVSPFPTRIGVDEIGDESFSDSPIHATTGVVDTLNATNPHVLTGDMTPFLDADATAVTASSRFFDHIPYENMNMSQNLHEPFQHLVPTNVCDFFQNQNMNQVQYQAPNNLFNQIQREFYNINLNLNLNLNSNQYLNQQQSFMNPMVEQHMNHVGGRESIPFVDGNCYNYHQLPSNQLPAVDHASTSYMPSTTGVYDPYINNNL

SEQ ID NO: 581 - DNA, 1104 bp, Arabidopsis thaliana
  G216
atgaacggagaaatctctcgtccgccggagctaatatcgtcccggaatccttgcaagagttttgaaaatgcaatacacaaagcagttgaggcagagctcgccgagctagcgaaaagcgacgcgaacggcggcggaaagagtaaagtgaaaggaccttggttgccggagcaagatgaggctctcacgaggcttgtgaaaatgtgtgggccgaggaactggaatctaatctcccgtggaatcccaggtcgctctggtaaatcttgccgattacgttggtgtaatcagctcgatcctatcctcaaacgaaaacctttctctgatgaggaggagcatatgataatgtctgcacaggcggttcttgggaacaaatggtctgtgattgctaaactcttacctgggagaacagataatgccattaagaatcattggaactctaatcttagacgtaaaccagcagaacaatggaagattcctctattgatgtctaatacagagatagtatatcaactgtatccatcaatggtcagaaggatatcaaacgcatcccccaaagaacatctacctcaagaagaagaaaccggtgtattaagtgatgataaaatggatgatgaagcaaaggagcctcctcgggagcaaaatagtaaaactggtgtttatcgtccagtggctcgaatgggtgctttcagtgtctgtaaaccaggatacatggctccatgtgagggacctttggttcaagcatcaagacctgactcattggctggtaaatttcttcagtctctttgttatgatcctattatcccttcaaaatgcggtcacggttgctgcaaccatcaagacagcacaacactgtcatcatcgtcggtgctgggatcagagtttgtggattatgaggaacattcttctgcagagttagataaagaattgatctctatatcaaatgacctgaacaatactgcttggattaggagtgggaaggaagctgaacagagtttgaaggctgatgatcagtttcgtcgtgagtatgctcactcgaaatttagtggaatggtaaacaatggtgtatcaagtcagatggtgagacaagatttaagggctttgagctaa

SEQ ID NO: 582 - protein, 367 aa, Arabidopsis thaliana
  G216
MNGEISRPPELISSRNPCKSFENAIHKAVEAELAELAKSDANGGGKSKVKGPWLPEQDEALTRLVKMCGPRNWNLISRGIPGRSGKSCRLRWCNQLDPILKRKPFSDEEEHMIMSAQAVLGNKWSVIAKLLPGRTDNAIKNHWNSNLRRKPAEQWKIPLLMSNTEIVYQLYPSMVRRISNASPKEHLPQEEETGVLSDDKMDDEAKEPPREQNSKTGVYRPVARMGAFSVCKPGYMAPCEGPLVQASRPDSLAGKFLQSLCYDPIIPSKCGHGCCNHQDSTTLSSSSVLGSEFVDYEEHSSAELDKELISISNDLNNTAWIRSGKEAEQSLKADDQFRREYAHSKFSGMVNNGVSSQMVRQDLRALS

SEQ ID NO: 583 - DNA, 1033 bp, Arabidopsis thaliana
  G221
ctctcttattctctcactcttttttttttatattcctctctctctaaatctataaaatatatttaaaaacttgatcgtatataataaagtaaataaagaataataacaaaaaaaatggagaaaagaggaggaggaagtagtggaggttcgggatcatcagcagaagcagaagtgagaaaaggaccatggacgatggaagaagatcttattcttatcaactatatcgccaaccacggcgatggtgtttggaattctctcgccaaatctgcaggtctaaaacgaaccgggaaaagttgccggctccggtggctgaactatctccgccccgacgtacgacggggaaacatcactccagaagagcaacttatcatcatggaacttcatgctaagtggggaaacaggtggtcgaaaatcgccaaacatcttccaggaagaacggacaacgagatcaaaaatttctgtaggacaagaattcaaaaatacatcaagcaatcggatgtaacaacaacatcgtccgttggatctcatcatagctcagagatcaacgatcaagctgcaagcacgtcgagccataatgtcttttgtacacaagatcaagcgatggagacttattctcctacaccgacatcatatcaacataccaatatggaattcaactatggtaactattcggccgcggcagtgacggcaaccgtggattatccagtaccgatgaccgttgatgatcaaaccggtgaaaactattggggcatggatgatatttggtcatcaatgcatttattgaatggtaattgattgatcggtggacaaaacatggaatattaattgagtattatatatgatttttaggagtactattattagtacgtgacatgtatatgtttttgcctcgttgtagaggtttggggttataattaatatataatgttatctaatatgcaaccttgatacatatttggatctttattgaacccatgttatacataaataaaattgttgaaggggtcataaaaaaaaaaaaaaaaaaaaaaaa

SEQ ID NO: 584 - protein, 226 aa, Arabidopsis thaliana
  G221
MEKRGGGSSGGSGSSAEAEVRKGPWTMEEDLILINYIANHGDGVWNSLAKSAGLKRTGKSCRLRWLNYLRPDVRRGNITPEEQLIIMELHAKWGNRWSKIAKHLPGRTDNEIKNFCRTRIQKYIKQSDVTTTSSVGSHHSSEINDQAASTSSHNVFCTQDQAMETYSPTPTSYQHTNMEFNYGNYSAAAVTATVDYPVPMTVDDQTGENYWGMDDIWSSMHLLNGN

SEQ ID NO: 585 - DNA, 1256 bp, Arabidopsis thaliana
  G232
aaaaaaagaattacaattaataagaacaagatcaagaatcaagaatcaagaaaatgggaagagcaccgtgttgtgataaggccaacgtgaagaaagggccttggtctcctgaggaagacgccaaactcaaagattacatcgagaatagtggcacaggaggcaactggattgctttgcctcagaaaattggtttaaggagatgtgggaagagttgcaggctaaggtggctcaactatttgagaccaaacatcaaacatggtggcttctccgaggaagaagacaacatcatttgtaacctctatgttactattggtagcaggtggtctataattgctgcacaattgccgggaagaaccgacaacgatatcaaaaactattggaacacgaggctgaagaagaagcttctgaacaaacaaaggaaagagttccaagaagcgcgaatgaagcaagagatggtgatgatgaaaaggcaacaacaaggacaaggacaaggtcaaagtaatggtagtacggatctttatcttaacaacatgtttggatcatcaccatggccattactaccacaacttcctcctccacatcatcaaatacctcttggaatgatggaaccaacaagctgtaactactaccaaacgacaccgtcttgtaacctagaacaaaagccattgatcacactcaagaacatggtcaagattgaagaagaacaggaaaggacaaaccctgatcatcatcatcaagattctgtcacaaacccttttgatttctctttctctcagcttttgttagatcccaattactatctgggatcaggagggggaggagaaggagattttgctatcatgagcagcagcacaaactcaccattaccaaacacaagtagtgatcaacatccaagtcaacagcaagagattcttcaatggtttgggagcagtaactttcagacagaagcaatcaacgatatgttcataaacaacaacaacaacaacaacatagtgaatcttgagaccatcgagaacacaaaagtctatggagacgcctcagtagccggagccgctgtccgagcagctttggccggagggacaacgagtacatcggcggatcaaagtacaataagttgggaggatataacttctctagttaattccgaagatgcaagttacttcaatgcgccaaatcatgtgtaacattttgtttaaaactttatttgtacttacatacataaagaggggttttctattttgtaaaaaaaaaaaaaa

SEQ ID NO: 586 - protein, 376 aa, Arabidopsis thaliana
  G232
MGRAPCCDKANVKKGPWSPEEDAKLKDYIENSGTGGNWIALPQKIGLRRCGKSCRLRWLNYLRPNIKHGGFSEEEDNIICNLYVTIGSRWSIIAAQLPGRTDNDIKNYWNTRLKKKLLNKQRKEFQEARMKQEMVMMKRQQQGQGQGQSNGSTDLYLNNMFGSSPWPLLPQLPPPHHQIPLGMMEPTSCNYYQTTPSCNLEQKPLITLKNMVKIEEEQERTNPDHHHQDSVTNPFDFSFSQLLLDPNYYLGSGGGGEGDFAIMSSSTNSPLPNTSSDQHPSQQQEILQWFGSSNFQTEAINDMFINNNNNNNIVNLETIENTKVYGDASVAGAAVRAALAGGTTSTSADQSTISWEDITSLVNSEDASYFNAPNHV

SEQ ID NO: 587 - DNA, 731 bp, Arabidopsis thaliana
  G249
ccgccgacatggagaaaagagaaagtagtggtgggtctggatcaggagatgcagaggtgagaaaagggccatggacgatggaagaagatttgattctcatcaattatatcgccaatcatggtgaaggtgtttggaactctctcgccaaatctgcaggactaaaacgcaccgggaaaagttgccggctccggtggctgaactacctccgacctgatgcgcgacggggaaatatcacaccagaagaacagctcaccatcatggaacttcatgcaaaatggggaaataggtggtcaaaaattgcaaagcatttaccaggaagaaccgacaatgagataaagaatttttggaggactaagatccagaaatacatcatcaagagcggagaaacgacgaccgttggatcacaaagctccgagtttataaaccatcatgcgacaacgagccatgtcatgaatgatactcaagaaaccatggatatgtattctccaacgacgtcgtatcaacatgccagcaatattaatcagcagcttaattatggtaattatgtgcctgaatccggttcgatcatgatgccattatctgttgatcagtccgaacaaaactattggagcgtcgatgatctttggcccatgaatatatataatggtaattaataaataagttcgttaaaacttatatatatttacggtccaaagagggttctatataaacagagtactgtatgggattgc

SEQ ID NO: 588 - protein, 214 aa, Arabidopsis thaliana
  G249
MEKRESSGGSGSGDAEVRKGPWTMEEDLILINYIANHGEGVWNSLAKSAGLKRTGKSCRLRWLNYLRPDARRGNITPEEQLTIMELHAKWGNRWSKIAKHLPGRTDNEIKNFWRTKIQKYIIKSGETTTVGSQSSEFINHHATTSHVMNDTQETMDMYSPTTSYQHASNINQQLNYGNYVPESGSIMMPLSVDQSEQNYWSVDDLWPMNIYNGN

SEQ ID NO: 589 - DNA, 1547 bp, Arabidopsis thaliana
  G256
tcgtgagcgttgtgtttctcctcaacattcaaagtctttagtgaaacctctcttgtaagaagccaaaaaaataaagagaaagattcaaagaaggaaagaaattgaggatgactatttcaagtccaaagagagattttgagtagaccctcttcacaaaaatccaatcttagagtcttactagttactatctagcttacatacacagagacactataccaaaaatccaatcttattagagtacttactatatagcttacacatacacacacacgaagtactatttcaacgatcaagagcgtgtgcgtgaggatatgggtagaccaccttgttgcgagaagattgaggtgaagaaaggaccatggactcccgaagaagacataatcttggtctcttatatccaacaacacggccctggaaattggagatctgtccctgcaaacaccggtttgctaaggtgtagcaagagttgcagacttagatggactaattaccttcgtcccgggatcaaacgaggaaatttcactcaaccggaagagaagatgatcatccaccttcaagctcttttgggaaatagatgggcagctatagcatcatatctacctcagaggaccgacaatgatatcaagaactactggaacactcatcttaaaaagaaactagtgatgatgaagtttcaaaatggtatcatcaacgaaaacaaaaccaatctggcaacagatatttcgtcttgtaataataacaacaatggatgtaatcacaacaaaaggaccaccaacaaaggccaatgggagaaaaaacttcaaacagacatcaacatggccaaacaagccttattccaagccttgtcacttgaccaaccatcttcattgatccctcccgatcctgactcaccaaaacctcatcatcattctaccaccacttatgcctcaagcacagataacatctctaaattactccagaactggacaagctcatcatcgtcaaagcctaacacttcatcagtctccaacaaccggagctcaagccccggtgaaggaggactttttgatcatcactctttgttctcatcgaattcagaatctggatcagttgatgagaagctgaatttgatgtccgagacaagcatgttcaaaggtgagagcaagccagacatagacatggaagctacacctactactactactactactactgatgatcaaggctcgttgtcattgatcgagaaatggttgtttgatgatcaaggcttggttcagtgtgatgatagtcaagaagatctcatcgacgtgtctttagaggagttaaaataatgataacaacagtcaagatttgttctataagaaaataaaacgtatagaacaacgataaagctagctaggtttattaatttttctttcttttgtcttttctctatgatctttagttacattttattttactgtgtggcttgcttgtggtcaagtcgatgaagatcaaactgtgatatactatttatatgtaaagtactataaagttaagagtagttgaataaaaaaaaaaaaaaaaaa

SEQ ID NO: 590 - protein, 332 aa, Arabidopsis thaliana
  G256
MGRPPCCEKIEVKKGPWTPEEDIILVSYIQQHGPGNWRSVPANTGLLRCSKSCRLRWTNYLRPGIKRGNFTQPEEKMIIHLQALLGNRWAAIASYLPQRTDNDIKNYWNTHLKKKLVMMKFQNGIINENKTNLATDISSCNNNNNGCNHNKRTTNKGQWEKKLQTDINMAKQALFQALSLDQPSSLIPPDPDSPKPHHHSTTTYASSTDNISKLLQNWTSSSSSKPNTSSVSNNRSSSPGEGGLFDHHSLFSSNSESGSVDEKLNLMSETSMFKGESKPDIDMEATPTTTTTTTDDQGSLSLIEKWLFDDQGLVQCDDSQEDLIDVSLEELK

SEQ ID NO: 591 - DNA, 1099 bp, Arabidopsis thaliana
  G350
acagttgtacaaaaaagcaggcgtggtaccggaccggtaattcccggggatatcgtcgtacccacgcgtccgctcgacacgcaacttccttcctcttcagactcctctgactttactatatataacacacacactttcatttcttgtttcttcaaatcaaatcttttcatttacaattatctttcttctcaatttagaacttagtagctagtcttcaagataatggcacttgaaactcttacttctccaagattatcttctccgatgccgactctgtttcaagattcagcactagggtttcatggaagcaaaggcaaacgatctaagcgatcaagatctgaattcgaccgtcagagtctcacggaggatgaatatatcgctttatgtctcatgcttcttgctcgcgacggagatagaaaccgtgaccttgacctgccttcttcttcgtcttcacctcctctgcttcctcctcttcctactccgatctacaagtgtagcgtctgtgacaaggcgttttcgtcttaccaggctcttggtggacacaaggcaagtcaccggaaaagcttttcgcttactcaatctgccggaggagatgagctgtcgacatcgtcggcgataaccacgtctggtatatccggtggcgggggaggaagtgtgaagtcgcacgtttgctctatctgtcataaatcgttcgccaccggtcaagctctcggcggccacaaacggtgccactacgaaggaaagaacggaggcggtgtgagtagtagcgtgtcgaattctgaagatgtggggtctacaagccacgtcagcagtggccaccgtgggtttgacctcaacataccgccgataccggaattctcgatggtcaacggagacgaagaggtgatgagtcctatgccggcgaagaaactccggtttgacttcccggagaaaccctaaacataaacctaggaaaaactttacagaattcattttataggaaattgttttactgtatatacaaatatcgattttgattgatgttcttcttcactgaaaaattatgattctttgttgtatacttgatgtttctgaaaaagatataactttttattaaaaa

SEQ ID NO: 592 - protein, 238 aa, Arabidopsis thaliana
  G350
MALETLTSPRLSSPMPTLFQDSALGFHGSKGKRSKRSRSEFDRQSLTEDEYIALCLMLLARDGDRNRDLDLPSSSSSPPLLPPLPTPIYKCSVCDKAFSSYQALGGHKASHRKSFSLTQSAGGDELSTSSAITTSGISGGGGGSVKSHVCSICHKSFATGQALGGHKRCHYEGKNGGGVSSSVSNSEDVGSTSHVSSGHRGFDLNIPPIPEFSMVNGDEEVMSPMPAKKLRFDFPEKP

SEQ ID NO: 593 - DNA, 775 bp, Arabidopsis thaliana
  G351
ctcacgcaacttcctctcttctcaagattcttctccatacttcaccttcttctatatatctctctgctctcaaattaggttttaaattttctatagcaatggcgcttgaagctcttaattcaccaagattggtcgaggatcccttaagattcaatggcgttgagcagtggaccaaatgtaagaaacgatccaaacgttcgagatctgatcttcatcataaccaccgtctcactgaggaagagtatctagctttctgtctcatgcttcttgctcgggatggcggcgatcttgactctgtgacggttgcggagaagccgagttataagtgtggcgtttgttacaagacgttttcgtcttaccaagctctcggcggtcataaagcgagccaccggagcttatacggtggtggagagaatgataaatcgacaccatccaccgccgtgaaatctcacgtttgttcggtttgcgggaaatctttcgccaccggtcaagctctcggcggccacaagcggtgccactacgatggtggcgtttcgaactcggaaggtgtggggtctactagccacgtcagcagtagtagccaccgtggatttgaccttaatattataccggtgcagggattttcgccggacgacgaagtgatgagtccgatggcgactaagaagcctcgcctgaagtaagtctttgttgaagacctggaagtttatcaaatgtaaatatcaaatttcaatttcaaggaacagttttgttgattctattaccaatacacaatacg

SEQ ID NO: 594 - protein, 193 aa, Arabidopsis thaliana
  G351
MALEALNSPRLVEDPLRFNGVEQWTKCKKRSKRSRSDLHHNHRLTEEEYLAFCLMLLARDGGDLDSVTVAEKPSYKCGVCYKTFSSYQALGGHKASHRSLYGGGENDKSTPSTAVKSHVCSVCGKSFATGQALGGHKRCHYDGGVSNSEGVGSTSHVSSSSHRGFDLNIIPVQGFSPDDEVMSPMATKKPRLK

SEQ ID NO: 595 - DNA, 2217 bp, Arabidopsis thaliana
  G385
tagggtttgctttcagtttccggagtataagaaaagatgttcgagccaaatatgctgcttgcggctatgaacaacgcagacagcaataaccacaactacaaccacgaagacaacaataatgaaggatttcttcgggacgatgaattcgacagtccgaatactaaatcgggaagtgagaatcaagaaggaggatcaggaaacgaccaagatcctcttcatcctaacaagaagaaacgatatcatcgacacacccaacttcagatccaggagatggaagcgttcttcaaagagtgtcctcacccagatgacaagcaaaggaaacagctaagccgtgaattgaatttggaacctcttcaggtcaaattctggttccaaaacaaacgtacccaaatgaagaatcatcacgagcggcatgagaactcacatcttcgggcggagaacgaaaagcttcgaaacgacaacctaagatatcgagaggctcttgcaaatgcttcgtgtcctaattgtggtggtccaacagctatcggagaaatgtcattcgacgaacaccaactccgtctcgaaaatgctcgattaagggaagagatcgaccgtatatccgcaatcgcagctaaatacgtaggcaagccagtctcaaactatccacttatgtctcctcctcctcttcctccacgtccactagaactcgccatgggaaatattggaggagaagcttatggaaacaatccaaacgatctccttaagtccatcactgcaccaacagaatctgacaaacctgtcatcatcgacttatccgtggctgcaatggaagagctcatgaggatggttcaagtagacgagcctctgtggaagagtttggctttagacgaagaagaatatgcaaggacctttcctagagggatcggacctagaccggctggatatagatcagaagcttcgcgagaaagcgcggttgtgatcatgaatcatgttaacatcgttgagattctcatggatgtgaatcaatggtcgacgattttcgcggggatggtttctagagcaatgacattagcggttttatcgacaggagttgcaggaaactataatggagctcttcaagtgatgagcgcagagtttcaagttccatctccattagtcccaacacgtgaaacctatttcgcacgttactgtaaacaacaaggagatggttcgtgggcggttgtcgatatttcgttggatagtctccaaccaaatcccccggctagatgcaggcggcgagcttcaggatgtttgattcaagaattgccaaatggatattctaaggtgacttgggtggagcatgtggaagttgatgacagaggagttcataacttatacaaacacatggttagtactggtcatgccttcggtgctaaacgctgggtagccattcttgaccgccaatgcgagcggttagctagtgtcatggctacaaacatttcctctggagaagttggcgtgataaccaaccaagaagggaggaggagtatgctgaaattggcagagcggatggttataagcttttgtgcaggagtgagtgcttcaaccgctcacacgtggactacattgtccggtacaggagctgaagatgttagagtgatgactaggaagagtgtggatgatccaggaaggtctcctggtattgttcttagtgcagccacttctttttggatccctgttcctccaaagcgagtctttgacttcctcagagacgagaattcaagaaatgagtgggatattctgtctaatggaggagttgtgcaagaaatggcacatattgctaacgggagggataccggaaactgtgtttctcttcttcgggtaaatagtgcaaactctagccagagcaatatgctgatcctacaagagagctgcattgatcctacagcttcctttgtgatctatgctccagtcgatattgtagctatgaacatagtgcttaatggaggtgatccagactatgtggctctgcttccatcaggttttgctattcttcctgatggtaatgccaatagtggagcccctggaggagatggagggtcgctcttgactgttgcttttcagattctggttgactcagttcctacggctaagctgtctcttggctctgttgcaactgtcaataatctaatagcttgcactgttgagagaatcaaagcttcaatgtcttgtgagactgcttgaaaaccatccattagc

SEQ ID NO: 596 - protein, 721 aa, Arabidopsis thaliana
  G385
MFEPNMLLAAMNNADSNNHNYNHEDNNNEGFLRDDEFDSPNTKSGSENQEGGSGNDQDPLHPNKKKRYHRHTQLQIQEMEAFFKECPHPDDKQRKQLSRELNLEPLQVKFWFQNKRTQMKNHHERHENSHLRAENEKLRNDNLRYREALANASCPNCGGPTAIGEMSFDEHQLRLENARLREEIDRISAIAAKYVGKPVSNYPLMSPPPLPPRPLELAMGNIGGEAYGNNPNDLLKSITAPTESDKPVIIDLSVAAMEELMRMVQVDEPLWKSLALDEEEYARTFPRGIGPRPAGYRSEASRESAVVIMNHVNIVEILMDVNQWSTIFAGMVSRAMTLAVLSTGVAGNYNGALQVMSAEFQVPSPLVPTRETYFARYCKQQGDGSWAVVDISLDSLQPNPPARCRRRASGCLIQELPNGYSKVTWVEHVEVDDRGVHNLYKHMVSTGHAFGAKRWVAILDRQCERLASVMATNISSGEVGVITNQEGRRSMLKLAERMVISFCAGVSASTAHTWTTLSGTGAEDVRVMTRKSVDDPGRSPGIVLSAATSFWIPVPPKRVFDFLRDENSRNEWDILSNGGVVQEMAHIANGRDTGNCVSLLRVNSANSSQSNMLILQESCIDPTASFVIYAPVDIVAMNIVLNGGDPDYVALLPSGFAILPDGNANSGAPGGDGGSLLTVAFQILVDSVPTAKLSLGSVATVNNLIACTVERIKASMSCETA

SEQ ID NO: 597 - DNA, 1986 bp, Arabidopsis thaliana
  G389
atggaaacgaaagacaagaaagaaaaaggacatatggttttaaattccgacaacgttttcggttcggtgtcttcgtctccgacaacaacaatccaaaaccctaattactttacctccttcgagaaccctaatttcccttacatttttccgaaagaagagtatgaggtgatgagcaagatcgaaagcgggtcgggtaagtcaaccgggtcgggtcatgacccagtggagaatactgcaatcgaacaagagcctcctgcggcgaagaagaaacgttaccatagacatactgctagtcagattcaacaaatggaagcattgtttaaggaaaatgctcatccggataccaaaacaagattgagattaagtaaaaaacttggtctctcgccgatacaagtcaagttttggtttcaaaacaaacgtacccaaatcaaggcacaacaaagtagaagcgataatgcaaagctaaaagcagagaatgagactctaaagacagagagtcaaaatattcagtccaattttcaatgccttttttgctctacttgtggccacaatctccgcctcgaaaacgctcgcctccgccaagagcttgatcgtttacgcagcattgtttccatgaggaatccttctccttcacaagagattaccccggagactaataagaacaacaacgataatatgttgattgcggaagaagaaaaggcgattgatatggaacttgcagtttcttgtgctcgagaattagcaaagatgtgtgacataaatgagcccttgtggaataagaagagactagacaatgagagtgtgtgtctgaatgaggaagagtataagaagatgttcttatggcctctaatgaatgatgatgatcgttttcgcagagaagcttcaagagctaatgcagtcatcatgttgaactgcataaccctcgtcaaagcattccttgatgctgataaatggtcggaaatgttcttccccatagtctcaagcgccaaaacggctcagatcatttcttctggagcttctggaccaagtggtactcttcttctgcaaaatgctgaagaaggaaaatggatggttgtagatttcccgatcgataggatcaaaccagcatcagctactactactgatcaataccggagaaaaccttctggttgcatcattcaagcaatgcgtaacggatactctcaggtcacatgggtagagcacgtagaagtagaagagaagcacgtgcaggacgaggttgttagagagtttgtggagagcggtgtggcctttggcgctgaacggtggctatctgtgttgaagagacaatgtgaaaggatggctagtctcatggctacaaacatcactgaccttggaggtatatatataacttgtttcacaatgataccttctgtagaagcgaggaagaacttgatgaagctgtcacagagaatggtgaaaactttctgtctgaacataatcaattcacacggacaagcaccaacaaaggacacagttaaaatcgtaagcaggaaagtttgcggtggtcttgttccttgtgccgtgtcagtcacgcttctcccttattctcatcaacaagtctttgatcttctccgcgacaatcaacgtctctctcaggtggagagcaattcatcgcataatgtagagttgatgcttcaagaaacatgcaccgataactccgggagtctcctggtgtactctaccgtcgaccccgtcgctgttcagctcgccatgaacggcgaagatccttctgaaataccacttttgcccgttggattctctgttgttccagtgaatccatccgatggtgtcgagggcagttccgtcagttcgccttcgtgcttgctcactgttgcaatacaggtcttggggagcaacgtcaccaccgaaagactcgatctttccaccgtctccgtcatcaatcaccgtatttgcgccactgtcaaccgtatcacttccgcgctcgtcaacgacgtcggtaattaa

SEQ ID NO: 598 - protein, 661 aa, Arabidopsis thaliana
  G389
METKDKKEKGHMVLNSDNVFGSVSSSPTTTIQNPNYFTSFENPNFPYIFPKEEYEVMSKIESGSGKSTGSGHDPVENTAIEQEPPAAKKKRYHRHTASQIQQMEALFKENAHPDTKTRLRLSKKLGLSPIQVKFWFQNKRTQIKAQQSRSDNAKLKAENETLKTESQNIQSNFQCLFCSTCGHNLRLENARLRQELDRLRSIVSMRNPSPSQEITPETNKNNNDNMLIAEEEKAIDMELAVSCARELAKMCDINEPLWNKKRLDNESVCLNEEEYKKMFLWPLMNDDDRFRREASRANAVIMLNCITLVKAFLDADKWSEMFFPIVSSAKTAQIISSGASGPSGTLLLQNAEEGKWMVVDFPIDRIKPASATTTDQYRRKPSGCIIQAMRNGYSQVTWVEHVEVEEKHVQDEVVREFVESGVAFGAERWLSVLKRQCERMASLMATNITDLGGIYITCFTMIPSVEARKNLMKLSQRMVKTFCLNIINSHGQAPTKDTVKIVSRKVCGGLVPCAVSVTLLPYSHQQVFDLLRDNQRLSQVESNSSHNVELMLQETCTDNSGSLLVYSTVDPVAVQLAMNGEDPSEIPLLPVGFSVVPVNPSDGVEGSSVSSPSCLLTVAIQVLGSNVTTERLDLSTVSVINHRICATVNRITSALVNDVGN

SEQ ID NO: 599 - DNA, 1201 bp, Arabidopsis thaliana
  G398
agaaggtttctcttgtcctccatacacttagcacaactgataaatcttttgaggtaaaatcagctttagatcaaggtttttctagtcatctctactcataaagatcaaagcttttgctattctcattttctaccaagagacaatatcatgatgatgggtaaagaggatttgggtttaagtcttagcttgggatttgcacaaaaccatcctctccagctaaatcttaaacccacttcttcaccaatgtccaatctccagatgtttccatggaaccaaacccttgtttcttcctcagatcaacaaaagcaacagtttcttaggaaaatcgacgtgaacagcttgccaacaacggtggatttggaagaggagacaggagtttcgtctccaaacagtacgatctcgagcacagtgagtggaaagaggaggagtactgaaagagaaggtacctccggtggtggttgcggagatgaccttgacatcactctagatagatcttcctcacgtggaacctccgatgaagaggaagattacggaggtgagacttgtaggaagaagcttagactatccaaagatcaatccgcagttctcgaagacactttcaaagagcacaatactctcaatcccaaacagaagctggctttggctaagaagctaggtttaacagcaagacaagtggaagtgtggttccaaaacagaagagcaaggacaaagttaaagcagaccgaagtggattgcgagtatttgaaaagatgtgttgagaaattaacggaagagaatcggcggctcgagaaagaggcagcggaactaagagcattaaagctttcaccgcggttgtatggtcagatgagtccaccgaccacacttttgatgtgtccatcgtgtgaacgtgtggccggaccatcctcatctaaccacaaccagcgatctgtctcattgagtccatggctccaaatggcccatgggtcaacctttgatgtgatgcgtcctaggtcttaactttaatgctgcttctatgggttgtgtgtgggtcattgtactttttagattattgactctcagctaatgtatccttaaaagcctttttctacttttaaatttactttaatctaattaaattagttgtccatgtcttcttgataacaaaaaaatttataattataaaaaaaaaaaacaggataaaaaaaaaaaaaaaaaaaaaaaa

SEQ ID NO: 600 - protein, 282 aa, Arabidopsis thaliana
  G398
MMMGKEDLGLSLSLGFAQNHPLQLNLKPTSSPMSNLQMFPWNQTLVSSSDQQKQQFLRKIDVNSLPTTVDLEEETGVSSPNSTISSTVSGKRRSTEREGTSGGGCGDDLDITLDRSSSRGTSDEEEDYGGETCRKKLRLSKDQSAVLEDTFKEHNTLNPKQKLALAKKLGLTARQVEVWFQNRRARTKLKQTEVDCEYLKRCVEKLTEENRRLEKEAAELRALKLSPRLYGQMSPPTTLLMCPSCERVAGPSSSNHNQRSVSLSPWLQMAHGSTFDVMRPRS

SEQ ID NO: 601 - DNA, 977 bp, Arabidopsis thaliana
  G399
aggaaataaaaaacatgatgatgggcaaagaagatctaggtttgagcctaagcttagggttttcacaaaatcacaatcctcttcagatgaatctgaatcctaactcttcattatcaaacaatctccagagactcccatggaaccaaacattcgatcctacatcagatcttcgcaagatagacgtgaacagttttccatcaacggttaactgcgaggaagacacaggagtttcgtcaccaaacagtacgatctcaagcaccattagcgggaagagaagtgagagagaaggaatctccggaaccggcgttggctccggcgacgatcacgacgagatcactccggatcgagggtactcacgtggaacctcagatgaagaagaagacgggggcgaaacgtcgaggaagaagctcaggttatcaaaagatcagtctgcttttctcgaagagactttcaaagaacacaacactctcaatcccaaacagaagctagctttggctaagaagctgaacttgacggcaagacaagtggaagtgtggttccaaaacagaagagctagaaccaagttaaagcaaacggaggtagattgcgaatacttgaaacggtgcgtagagaagctaacggaagagaaccggagacttcagaaagaggctatggagcttcgaactctcaagctgtctccacaattctacggtcagatgactccaccaactacactcatcatgtgtccttcgtgcgagcgtgtgggtggcccatcatcatcgaaccatcaccacaatcacaggcccgtttctatcaatccgtgggttgcttgtgctggtcaggtggctcatgggctgaattttgaagccttgcgtccacgatcgtgattttttattttagtggtgggaaaagggtgttttggtatttttcgttatcgttatatagtctatctgtgtggggtcattgttattttggatgattggccttctcatgaacta

SEQ ID NO: 602 - protein, 283 aa, Arabidopsis thaliana
  G399
MMMGKEDLGLSLSLGFSQNHNPLQMNLNPNSSLSNNLQRLPWNQTFDPTSDLRKIDVNSFPSTVNCEEDTGVSSPNSTISSTISGKRSEREGISGTGVGSGDDHDEITPDRGYSRGTSDEEEDGGETSRKKLRLSKDQSAFLEETFKEHNTLNPKQKLALAKKLNLTARQVEVWFQNRRARTKLKQTEVDCEYLKRCVEKLTEENRRLQKEAMELRTLKLSPQFYGQMTPPTTLIMCPSCERVGGPSSSNHHHNHRPVSINPWVACAGQVAHGLNFEALRPRS

SEQ ID NO: 603 - DNA, 1535 bp, Arabidopsis thaliana
  G425
gaaaacagtcttctcttctccgatcccaaaaacgcaggaaaacaatgtcgtttaacagctcccacctccttcctccacaagaagaccttcctctccgacacttcaccgatcaatcacagcaacctccgccgcagcgtcacttctctgaaacaccttcgcttgtcaccgccagtttcctcaacctccctaccacccttaccactgcggattccgatctcgctcctccgcaccgcaacggagacaattccgttgctgatacaaacccacgctggctctcctttcattcggagatgcaaaatactggagaagtacgttctgaagttatcgacggagtcaacgccgatggtgaaacgatactcggcgttgtaggaggtgaagattggcggagtgctagctataaggcggcgattttaagacatccgatgtacgagcagcttcttgcggctcacgtggcttgccttagggttgcgactcccgttgaccagattccgaggatcgatgctcagctcagtcagttgcataccgtcgccgcgaaatactccactcttggtgtggttgttgacaacaaggaacttgatcatttcatgtcacattatgttgtcttgttatgttcatttaaagaacaactccaacaccacgtttgtgtccatgcaatggaagccattacggcttgttgggagattgaacaatcactgcaatccctaactggagtttctccaagtgaaagtaatggtaagacaatgtcggatgatgaagatgataatcaagtagagagcgaggtgaacatgtttgatggaagtttggacggttcagattgcttgatggggtttggtcctcttgttccaaccgagagagagagatctttgatggaacgtgtgaagaaagaactgaagcatgagcttaaacagggtttcaaagagaagattgtggacataagagaagagataatgaggaagagaagggcgggaaagttgccaggagatacgacttctgtactcaaagaatggtggcgaactcactcgaaatggccatacccaactgaggaagataaggcaaaactggttcaagaaaccggtttgcagttgaaacagatcaacaattggttcatcaaccagaggaaaagaaactggaacagcaactcttccacgtcatctactctcaccaagaacaaacgtaaacggaccgggaagtcgtaggtgacatagcggctaactagaggatggttctttgccatgtgaattcttgggaaccgtatatgaaagaaacgaatccggttctatgctcgtacagagtgtgttatttgtatagtggataccggttagcctatgaaaccggattctggagtccaaattgttgtttgtaacgacttagtagtttttggaagtgatctgtttcgttggtttgcgtcttgtaacgaacgcttaagcaagtgtgggttttttcttgtaaagtgtcaatatgttcgtttgtaatgaatgtatcaagcaatatttatcataattaaactagcttgaaatgtaaaaaaaaaaaaaaaa

SEQ ID NO: 604 - protein, 383 aa, Arabidopsis thaliana
  G425
MSFNSSHLLPPQEDLPLRHFTDQSQQPPPQRHFSETPSLVTASFLNLPTTLTTADSDLAPPHRNGDNSVADTNPRWLSFHSEMQNTGEVRSEVIDGVNADGETILGVVGGEDWRSASYKAAILRHPMYEQLLAAHVACLRVATPVDQIPRIDAQLSQLHTVAAKYSTLGVVVDNKELDHFMSHYVVLLCSFKEQLQHHVCVHAMEAITACWEIEQSLQSLTGVSPSESNGKTMSDDEDDNQVESEVNMFDGSLDGSDCLMGFGPLVPTERERSLMERVKKELKHELKQGFKEKIVDIREEIMRKRRAGKLPGDTTSVLKEWWRTHSKWPYPTEEDKAKLVQETGLQLKQINNWFINQRKRNWNSNSSTSSTLTKNKRKRTGKS

SEQ ID NO: 605 - DNA, 1751 bp, Arabidopsis thaliana
  G426
agagagagaactagtctgtgtcttttttttttttttttggtgataattgaaacatatgaaacaatcgtcgtcatagaagcagcagagattcaccttctttctttatctttccctctcagaaacaggaaacaaaattcaaaaagaacaaaaaaaaaaggtcaaaccaaaaacgatggcgtttcatcacaatcatctctctcaagacctctccttcaatcatttcaccgaccaacaccaacctccacctccgcaaccgcctcctcctcctccgcaacagcaacaacatttccaagaagcaccgcctcctaattggttaaacacagcgcttcttcgttcctcagataacaacaataacttcctcaacctccacacagccaccgctaacaccacaaccgcaagcagctccgattctccttcctccgccgccgccgccgccgctgctaaccagtggctatctcgctcctcctctttcctccaacgaaacaacaacaacaacgcttccatagtcggagatgggatcgatgatgtcaccggaggagcagacactatgattcagggagagatgaaaaccggcggtggagaaaacaaaaacgacggcggaggagctacggcggcggatggagtagtgagctggcagaatgcgagacacaaggcggagatcctttcgcatcctctttacgagcagcttttgtcggcgcacgttgcttgtttgagaatcgcgactccggttgatcagcttccgagaatcgatgctcagcttgctcagtctcaacacgtcgtcgctaaatactcagctttaggcgccgccgctcaaggtctcgtcggcgacgataaagaacttgaccagttcatgacacattatgtgttgctactgtgttcatttaaagagcaattgcaacaacatgtgcgtgttcatgcaatggaagctgtgatggcttgttgggagattgagcagtctcttcaaagcttaacaggagtgtctcctggagaagggatgggagcaacaatgtctgacgatgaagatgaacaagtagagagtgatgctaatatgttcgatgggggattagatgtgttgggttttggtcctttgattcctactgagagtgagaggtcgttgatggaaagagttagacaagaacttaaacatgaactcaaacagggttacaaggagaagatagtagacataagagaggagatattaaggaagagaagagctgggaagttaccaggagataccacctctgttctcaaagcttggtggcaatctcattccaaatggccttaccctactgaggaagataaggcgaggttggtgcaagagacaggtttgcagctaaaacagataaacaattggttcatcaatcagagaaagaggaactggcatagcaatccatcttcttccactgtattgaagaacaaacgcaaaagcaatgcaggtgacaatagcggaagagagcggttcgcgtagaaacaacaaacatatgatgtgaattggggaggtggaagatgggatttgaaagcagggttttagggatttaaagttgagaattttatggaggagtttgggttatacagagagaggggacagtattagaaagtaactttttgtgcaattacatagtaacgtagtttggttatgtgattatgcccatatattttattaagtagcacacaaaccaaaaagaaaatatgaaaactgaagatgcaggcttttgtttaatgttttttgtttgtttgtctgcaaaaaaaaa

SEQ ID NO: 606 - protein, 431 aa, Arabidopsis thaliana
  G426
MAFHHNHLSQDLSFNHFTDQHQPPPPQPPPPPPQQQQHFQEAPPPNWLNTALLRSSDNNNNFLNLHTATANTTTASSSDSPSSAAAAAAANQWLSRSSSFLQRNNNNNASIVGDGIDDVTGGADTMIQGEMKTGGGENKNDGGGATAADGVVSWQNARHKAEILSHPLYEQLLSAHVACLRIATPVDQLPRIDAQLAQSQHVVAKYSALGAAAQGLVGDDKELDQFMTHYVLLLCSFKEQLQQHVRVHAMEAVMACWEIEQSLQSLTGVSPGEGMGATMSDDEDEQVESDANMFDGGLDVLGFGPLIPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSSSTVLKNKRKSNAGDNSGRERFA

SEQ ID NO: 607 - DNA, 1507 bp, Arabidopsis thaliana
  G440
aaaaaatcactgtttcataacacgtttttctctctcacccaccaaaaaaaaatcttttgttcttgttaccaaaaaatctcgtgataaatctcttcaaactttgttttattttcttcttgattctctcgaaatctctctcaacaaacccagaaactttccttgattcgcaagcttttcttccttttatattcttcattttgatgcgaatatagagagagtccataaaagaaacagtaatggacgaatatattgatttccgaccattgaagtacacagagcacaagacttcaatgactaaatacaccaaaaagtcatcggaaaaactttccggtggtaagtcattgaaaaaggttagtatttgttatactgatcctgacgcaacagattcatcaagtgacgaagacgaagaagatttcttgtttcctcgccggagagtcaaaagattcgttaacgagatcactgttgagcctagctgtaacaacgtcgtcaccggagtttcgatgaaagatagaaagagactctcttcttcctccgatgaaactcaatctccggcgtcgagtcgtcaacgtcctaataacaaagtttcagtctccggtcagataaagaagttccgtggtgttagacaacggccatgggggaaatgggcggcggagattagagatccggagcaacgtcggaggatttggctcgggacttttgagacggcggaggaagctgccgtggtttatgataacgccgctataagactccgtggaccggacgctttaactaatttctccataccgcctcaagaagaggaagaagaagaagaaccggaaccggttattgaggagaaaccggttattatgacgacgccaacaccaacaacatcgagttctgaatcaactgaagaagatttacaacatctctcatctcctacttcggttctcaatcaccggtcagaagagattcaacaagtacaacaaccgtttaaatcagctaaacccgaaccgggggtttcaaatgcaccatggtggcataccgggtttaataccggtttaggtgaatcagacgattcatttcctttggatactccgtttcttgacaactatttcaatgaatcaccaccagagatgtcaatatttgaccaaccaatggatcaaattttctgtgaaaatgatgatatcttcaatgatatgttgttcttgggtggtgaaactatgaacattgaagatgagttaacaagttctagtatcaaagatatgggttcaacgtttagtgattttgatgattcattgatatcagatctattagttgcttaatatgatgatgagagtgaagaagaaaccatcaagcaaatatctatggtgtgactgaaaaattttggtgttacttttttttctttcataagttcatgagcttttttgtttcttttttttaataatttatttagttttgtcaggagcttgtaaaacagttttggagaaatagtggaaaaatagtttaattaaaaaaaaaaaaaaaaaaa

SEQ ID NO: 608 - protein, 354 aa, Arabidopsis thaliana
  G440
MDEYIDFRPLKYTEHKTSMTKYTKKSSEKLSGGKSLKKVSICYTDPDATDSSSDEDEEDFLFPRRRVKRFVNEITVEPSCNNVVTGVSMKDRKRLSSSSDETQSPASSRQRPNNKVSVSGQIKKFRGVRQRPWGKWAAEIRDPEQRRRIWLGTFETAEEAAVVYDNAAIRLRGPDALTNFSIPPQEEEEEEEPEPVIEEKPVIMTTPTPTTSSSESTEEDLQHLSSPTSVLNHRSEEIQQVQQPFKSAKPEPGVSNAPWWHTGFNTGLGESDDSFPLDTPFLDNYFNESPPEMSIFDQPMDQIFCENDDIFNDMLFLGGETMNIEDELTSSSIKDMGSTFSDFDDSLISDLLVA

SEQ ID NO: 609 - DNA, 960 bp, Arabidopsis thaliana
  G441
cactcactgagtcaaactcacgtgtcaatgaccgagtcatccattatctccgtcaaacaatcgtctccggtgccggaggaggaggatcatcatcatcaccaacaagactcccaccgaaccaacaccaagaaacgtgtaagatccgacccgggttaccgaggcgtccggatgcgaacgtggggcaaatgggtctccgagatccgagagcctcgcaagaagagccgaatctggctaggcactttctccacaccggaaatggcggcgcgtgcacatgacgcagctgctctcaccattaaaggaacttccgccgtcctcaacttcccggagctcgccacttaccttccccgtccagcttcctcctctccacgcgacgttcaagccgcagccgccgtagcggccgccatggacttctccccctcctcctcctctctcgtagtctccgatccaaccaccgtcatcgccccagctgagacgcagttgtcttcctcgagctattcaacgtgtacgtcatcgtcgttgtcaccgtcaagcgaagaagctgcgtcgacggcggaagaactaagcgagatagtggagttaccgagtctagagacgagttacgatgagtcattgagcgagtttgtgtacgttgactcggcgtatccacctagttcgccttggtatattaataattgttatagcttttattaccacagcgacgaaaatggcatttcgatggctgaacctttcgactcttccaattttggccccctttttccttagttttatttttaaataatctcttcttttaaaaacatttagcctccaaacctctgaagtttatttaattattggattcagaccagagtttaatatacttgattaaacctgatagtaccatataatgtttattgctctcttttttttgatcggatcttctagatattttgtacgaacacgccaattgtgattggacgataa

SEQ ID NO: 610 - protein, 244 aa, Arabidopsis thaliana
  G441
MTESSIISVKQSSPVPEEEDHHHHQQDSHRTNTKKRVRSDPGYRGVRMRTWGKWVSEIREPRKKSRIWLGTFSTPEMAARAHDAAALTIKGTSAVLNFPELATYLPRPASSSPRDVQAAAAVAAAMDFSPSSSSLVVSDPTTVIAPAETQLSSSSYSTCTSSSLSPSSEEAASTAEELSEIVELPSLETSYDESLSEFVYVDSAYPPSSPWYINNCYSFYYHSDENGISMAEPFDSSNFGPLFP

SEQ ID NO: 611 - DNA, 1431 bp, Arabidopsis thaliana
  G518
atggctccggtctcgttgcctccaggttttaggttccatccaacggacgaagaactaatcacttactatctcaagagaaagatcaacggccaagagatcgagctagagattatccctgaagtagacctctacaagtgcgaaccatgggacttgccagggaagtcactgattcctagcaaagaccaagaatggttcttcttcagcccacgggacagaaagtaccccaatggttcaaggacaaaccgggcaacaaaaggcggttattggaaagccacaggcaaagaccggcgggtgagttggagagatcgagccattgggaccaagaaaacattagtttactaccgtggacgtgccccgcatggtattagaactggttgggtcatgcatgaatatcgcctcgatgaatccgaatgcgagccttctgcatttggcatgcaggacgcatatgcactctgtcgcgtgtttaagaaaatagtgattgaggcgaaaccaagggatcaacatcagcagcagcatcaaccttacgtccacacgagctcgaatataagtggtagctcgagttttgacgtttgttcagatcttgaaataagttcaaacacaccttataataccgctgcccatatccaaccgcgatttggaaacgcaaacgcaattagtgatcatgatgactggtcgcagtacttgtcacaaaacatgcctacaagcttttcagattacggatctccttatggaccatacctcactcaatcaaaggtgaatacagaagtgcaatgtgagatgtttcaacaccaaatgtcattgccaccattgcgagtagaaaactcgcaggctcaaaccagcgatttctccaagagactacatcaaaacagtggtcaaagtgggttcgacgactttactttcgctacaagtaactccaaccaattctacaacagcaacgttgatgatcatttgatacacattggaaatcttgacgagcagagttatatagaagaacaagaattgattttgccaagtttccagagtaatgatcaagatcttgaactttatggcggatctcggaccaatacaataggcaacatagagatcgacgattttttctcgtttgagaaccaagcacaagacaacgacaactcaaacgtaaccccaaactcggcaggattcgaaatgattggagaagagattatagtaaaccataaaatgctcattagtacacggcagactacggagattttatactatcaagtggtaccgtcgcagatattgaaaattcacataaatccggttcatggaaatgaagagagaacaatgttaatggaagaagacagtgatgattcttggttccagaaggctgaaaatgttgcgaagatgaaactgaaacagattagtttagttgcaaaacgttattacaaatgtcttactattattttctga

SEQ ID NO: 612 - protein, 476 aa, Arabidopsis thaliana
  G518
MAPVSLPPGFRFHPTDEELITYYLKRKINGQEIELEIIPEVDLYKCEPWDLPGKSLIPSKDQEWFFFSPRDRKYPNGSRTNRATKGGYWKATGKDRRVSWRDRAIGTKKTLVYYRGRAPHGIRTGWVMHEYRLDESECEPSAFGMQDAYALCRVFKKIVIEAKPRDQHQQQHQPYVHTSSNISGSSSFDVCSDLEISSNTPYNTAAHIQPRFGNANAISDHDDWSQYLSQNMPTSFSDYGSPYGPYLTQSKVNTEVQCEMFQHQMSLPPLRVENSQAQTSDFSKRLHQNSGQSGFDDFTFATSNSNQFYNSNVDDHLIHIGNLDEQSYIEEQELILPSFQSNDQDLELYGGSRTNTIGNIEIDDFFSFENQAQDNDNSNVTPNSAGFEMIGEEIIVNHKMLISTRQTTEILYYQVVPSQILKIHINPVHGNEERTMLMEEDSDDSWFQKAENVAKMKLKQISLVAKRYYKCLTIIF

SEQ ID NO: 613 - DNA, 1104 bp, Arabidopsis thaliana
  G572
aggtaaccatggtccacaattgtccccctactagtctatatgaacacctcttctcaccacacacaccaaacattcatcacaattccctaaatcctacaatctttcttttcttccatcacctaagagtaaaccctaccttgcgtcccaagtctccaccgataatgcaaccatccaccaacatttttagcctccatggttgtccaccttcgtacctttcccatattcctacatcctcaccattttgcggacaaaaccctaatccattcttcagcttcgaaactggcgtgaacacttcacagttcatgagtttgatcagcagcaacaactcgacctcagatgaagcagaagagaatcataaggagataataaatgagaggaagcaaaagaggaagatatctaacagagaatcggcaagaagatcgcgtatgaggaagcagagacaagtggatgagctttggtcacaggtgatgtggcttagggatgagaatcatcagctgcttcgtaagcttaactgcgttttagagtctcaagagaaggttattgaagagaatgttcagctcaaagaggaaaccactgagcttaagcaaatgattagtgatatgcagcttcagaatcagagtcctttctcttgcatcagagacgacgacgacgttgtatagatgatttttatttttatttttttggggctctagtatgtatcaacaaatgtatatccagagatctgtctcagcttaagatttaattaagactctaaattagtaattgttaaagcagagttcttcaaacttgtgttgcccgtgaatagaagtaagaaattgtttcacaattgtttgcataacaaacgataaaaattcacattgctgaagtataattttaaaaaaaattacatgcataaatatttttgcaaaatgtaaatacaagcatcaattactaacagtagactttcttctttttctctttaaaattttacgtttataatgaccaattttgttctttctaaattggcttaagtagtgtctttgaaaaaaatatacaccagccgtaaacggtttattttcttccatttccatttgcatttttatgttgaaaaattattaagaaaag

SEQ ID NO: 614 - protein, 216 aa, Arabidopsis thaliana
  G572
MVHNCPPTSLYEHLFSPHTPNIHHNSLNPTIFLFFHHLRVNPTLRPKSPPIMQPSTNIFSLHGCPPSYLSHIPTSSPFCGQNPNPFFSFETGVNTSQFMSLISSNNSTSDEAEENHKEIINERKQKRKISNRESARRSRMRKQRQVDELWSQVMWLRDENHQLLRKLNCVLESQEKVIEENVQLKEETTELKQMISDMQLQNQSPFSCIRDDDDVV

SEQ ID NO: 615 - DNA, 861 bp, Arabidopsis thaliana
  G654
gtgacagggtttagctcaaggagagggtgagaaaaagaagaagaaggtgagaaaagtgaaggcaaggctttgaggatgtcttttacaggaactcaacagaaatgcaaggcttgtgagaagactgtttatgctgttgagcttctctctgctgatggagttggatatcacaagtcttgcttcaaatgcactcactgcaaaagcaggcttcagctgagtagttactcatcaatggaaggtgttttgtactgtaagcctcattttgagcagctctttaaggagagtggtagtttcaacaagaactttcagtcacctgcaaaatcggctgacaaatcaactcctgagctgacaaggacgcctagccgagttgctggcaggttctctggtacacaagagaaatgcgccacttgtagtaaaactgtgtatcctattgaaaaggtaacagtcgagagccagacatatcacaagtcctgcttcaagtgctcacatggaggttgcccaatttcaccttccaactacgcagctcttgaaggaatcctgtactgcaagcaccatttcgctcagctcttaaggagaagggaagttacaaccacttaatcaaatccgcttccatcaaacgcttcgcagccgcagcagtcgccgccggtgtaccagcagcctccgttcctgaatcttaaaatccaataatttctcctctctagtctaaaatttgaagttaatgccaaactgattcagtttgattctctttgtgagagcgtgtgtgtaatctatgcttgatgttcttatttccattgatgtctcctaaaaatctatgtttgtgtggtgtttggttatctataaaaagtctgaaactttccttataaa

SEQ ID NO: 616 - protein, 172 aa, Arabidopsis thaliana
  G654
MSFTGTQQKCKACEKTVYAVELLSADGVGYHKSCFKCTHCKSRLQLSSYSSMEGVLYCKPHFEQLFKESGSFNKNFQSPAKSADKSTPELTRTPSRVAGRFSGTQEKCATCSKTVYPIEKVTVESQTYHKSCFKCSHGGCPISPSNYAALEGILYCKHHFAQLLRRREVTTT

SEQ ID NO: 617 - DNA, 1310 bp, Arabidopsis thaliana
  G666
attagatccatttcagagctaagcgtactaattagtgtactaagggtagtgtgactcattaccacctaaagtagtttcaattttcttctatttttcttggcaaagagttatagtgggaaacaaagggagtggttaataaagaattaattagttaattaagggagttcaagatcataatggtgaggcctccttgttgtgacaaaggaggagtgaagaaagggccatggactcctgaagaagatatcattttagtcacttacatccaagaacatggtcctggtaattggagagctgttcctaccaatactgggctgcttagatgcagtaagagttgtagacttagatggacaaactatttaaggccaggaatcaaaagaggcaatttcacagaacatgaagaaaagatgattgttcatctccaagccctcttaggaaatagatgggctgcaattgcgtcatatcttccacaaaggacagacaatgacattaagaactattggaacactcatttgaagaagaaactcaacaaagtcaatcaagattctcatcaagaacttgaccgttcctcgctctcatcttcaccatcgtcttcttctgctaattccaactcaaacatctcaagaggccaatgggaaaggcgacttcaaaccgatatccacttggcgaaaaaggctctctctgaggctttatctcctgccgttgcaccaatcattacatctacagtgacaacaacgtcttcctctgctgaatcaagacgctctacttcctcagctagcgggtttcttaggacgcaagaaacatctacaacttatgcctcaagcaccgaaaatatcgcgaaattgctcaaagggtgggtgaaaaactcgccgaagactcaaaactccgcggatcaaatcgcttctacagaggtaaaagaagtgatcaagagtgatgatgggaaggagtgtgcaggggcatttcagtcattttctgagtttgatcactcatatcaacaggctggtgtttcacctgatcatgagaccaaaccagacataactggatgctgcagtaaccaaagtcaatggtctttgtttgagaagtggttgtttgaggattctggtggacagattggtgatattctattggatgaaaacactaatttcttctgaagagtttgctttaatcacatggttctaattttaggatcctcatctctattttttttttgggttttccaaattaactcgcttagattatcgtgagataaatcagtaataattttatttattttccctctttaatttacaattaatgatggggttgcttttaaa

SEQ ID NO: 618 - protein, 323 aa, Arabidopsis thaliana
  G666
MVRPPCCDKGGVKKGPWTPEEDIILVTYIQEHGPGNWRAVPTNTGLLRCSKSCRLRWTNYLRPGIKRGNFTEHEEKMIVHLQALLGNRWAAIASYLPQRTDNDIKNYWNTHLKKKLNKVNQDSHQELDRSSLSSSPSSSSANSNSNISRGQWERRLQTDIHLAKKALSEALSPAVAPIITSTVTTTSSSAESRRSTSSASGFLRTQETSTTYASSTENIAKLLKGWVKNSPKTQNSADQIASTEVKEVIKSDDGKECAGAFQSFSEFDHSYQQAGVSPDHETKPDITGCCSNQSQWSLFEKWLFEDSGGQIGDILLDENTNFF

SEQ ID NO: 619 - DNA, 1056 bp, Arabidopsis thaliana
  G668
atgggaagaccaccttgctgtgaaaagattggagtgaagaaagggccatggacaccagaggaagacatcatcttggtttcttacatccaagaacatggtcctggaaactggagatctgtcccaacacacacaggtttaagatgtagcaagagctgcagattgagatggactaattatcttcgacccggtattaagcgtggaaattttactgagcatgaagagaagacaattgttcatcttcaagcccttttaggcaacagatgggcagccatagcatcataccttccagaaaggacagacaatgatataaagaactattggaacactcacttgaagaagaagctcaaaaagattaatgaatctggtgaagaagataatgatggtgtctcttcatcaaacactagttcacaaaagaaccatcaaagcactaacaaaggtcaatgggaaagaagacttcagacagacattaacatggcaaaacaagctctttgtgaggccttgtctttagacaaaccatcatccactctttcatcatcttcatcattaccgacaccagtaatcacacaacaaaacatccgtaacttctcatcagctttgcttgaccgttgttatgatccatcctcttcttcttcatctaccacaaccaccactacaagcaacactactaatccatacccatcaggggtatatgcgtcaagtgctgagaacatcgcccggttgcttcaagatttcatgaaagacacacccaaggctttaactttatcatcttcatctccggtttcagagactggaccactcactgctgcagtctcggaagaaggtggagaagggtttgaacaatctttcttcagcttcaattcaatggacgaaactcaaaacttgactcaggagacaagcttcttccatgatcaagtgatcaaaccggaaataacaatggaccaagatcatggtctaatatcacaagggtctctgtctttgtttgagaaatggttatttgatgagcaaagccacgagatggttggtatggcactagcaggacaagaagggatgttctag

SEQ ID NO: 620 - protein, 351 aa, Arabidopsis thaliana
  G668
MGRPPCCEKIGVKKGPWTPEEDIILVSYIQEHGPGNWRSVPTHTGLRCSKSCRLRWTNYLRPGIKRGNFTEHEEKTIVHLQALLGNRWAAIASYLPERTDNDIKNYWNTHLKKKLKKINESGEEDNDGVSSSNTSSQKNHQSTNKGQWERRLQTDINMAKQALCEALSLDKPSSTLSSSSSLPTPVITQQNIRNFSSALLDRCYDPSSSSSSTTTTTTSNTTNPYPSGVYASSAENIARLLQDFMKDTPKALTLSSSSPVSETGPLTAAVSEEGGEGFEQSFFSFNSMDETQNLTQETSFFHDQVIKPEITMDQDHGLISQGSLSLFEKWLFDEQSHEMVGMALAGQEGMF

SEQ ID NO: 621 - DNA, 1212 bp, Arabidopsis thaliana
  G759
aaaaaatatgggtatccaagaaactgacccgttaacgcaattgagtttaccaccgggtttccgattttacccgaccgatgaagagcttatggttcaatatctctgtagaaaagcagctggttacgatttctctcttcagctcatcgccgaaatagatctttacaaattcgatccatgggttttaccaaataaagcattatttggagaaaaagaatggtatttttttagtcctagggatagaaaatatccaaacgggtcaagacctaaccgggttgccggatcgggttattggaaagctacgggtacggataaaataatctcgacggaaggacaaagagttggtattaaaaaagctttggtgttttacatcggaaaagctcctaaaggtactaaaaccaattggatcatgcatgagtatcgtctcattgaaccttctcgtagaaacggaagcactaagttggatgattgggttctatgtcgaatatacaagaagcaatcaagtgcacaaaaacaagtttacgataatggaatcgcgaatgctagagaattcagcaacaacggtacttcgtccacgacgtcgtcttcttctcactttgaagacgttcttgattcgtttcatcaagagatcgacaacagaaatttccagttttctaacccaaaccgcatctcgtcgctcagaccggacttaaccgaacagaaaaccgggttccacggtcttgcggatacttctaacttcgattgggctagttttgccggtaatgttgagcataataactcggtaccggaactcggaatgagtcatgttgttcctaatctcgagtacaactgtggctacctgaagacggaggaggaagtcgagagcagtcacgggtttaataactcgggcgagttagctcaaaagggttatggtgttgactcgtttgggtattcggggcaagttggtgggtttgggtttatgtgatgatgaaatgctgacgcaataaaaataagtcgttaatttttgtcccgtggcaaatcttatatgtatttgaatttcaattcttttgggttaagagggagactcatagatttagatgtagatttgtaatctttcatgcatagaaaatttgacgaatagatttcgtaactttattttgttgctgtttggttatctttgtattggtataaatttagtggattgaaattgcatattgaaaaaaaaaaaaaaaaaaa

SEQ ID NO: 622 - protein, 317 aa, Arabidopsis thaliana
  G759
MGIQETDPLTQLSLPPGFRFYPTDEELMVQYLCRKAAGYDFSLQLIAEIDLYKFDPWVLPNKALFGEKEWYFFSPRDRKYPNGSRPNRVAGSGYWKATGTDKIISTEGQRVGIKKALVFYIGKAPKGTKTNWIMHEYRLIEPSRRNGSTKLDDWVLCRIYKKQSSAQKQVYDNGIANAREFSNNGTSSTTSSSSHFEDVLDSFHQEIDNRNFQFSNPNRISSLRPDLTEQKTGFHGLADTSNFDWASFAGNVEHNNSVPELGMSHVVPNLEYNCGYLKTEEEVESSHGFNNSGELAQKGYGVDSFGYSGQVGGFGFM

SEQ ID NO: 623 - DNA, 1913 bp, Arabidopsis thaliana
  G789
ggcaagaagaaccttagcctctctttcttctttctctctctctctctctgtggtactgttctgtttcaactttactccctcagtttcagaacaattccctatctagaagagagataaaaccgagaaggttttggagatagaatcttttgttcttcttttgtccctccttgctcgatttttgttacgtgtgaagcaataaaaaaaaactgatatagctaaatcttccatccattcagaggcttctaaatctgatctgacatggaacaagtgtttgctgattggaattttgaagataattttcacatgtccactaataaaagatcaatcagaccagaagatgaattagtggagctattgtggagagatggtcaagtggttttacaaagccaagctcgtagagaaccgtcagtccaagtccaaacccacaaacaagaaaccctaagaaaacccaacaatatttttcttgacaaccaagaaacagtacaaaagcctaactacgctgctctagatgatcaagaaaccgtctcctggatacaataccctccggatgacgtcatcgaccctttcgaatccgagttctcctctcatttcttctcttcgatcgatcacctcggaggtcctgagaagccacgaacgatcgaagagacagttaagcatgaggctcaagccatggctcctcctaagtttagatcctcggttataacagtcggaccgagtcattgcggcagcaaccagtcaacaaatattcatcaggccactacacttccggtttctatgagtgatagaagcaagaacgtcgaagaaagacttgacacttcgtcaggtggctcctccggttgcagctatggaaggaacaacaaagaaaccgttagtggaacaagtgtaaccattgaccgtaaaagaaaacatgttatggatgctgatcaagaatctgtgtctcaatcagatataggtttgacctcaaccgatgatcaaaccatgggtaacaaatcgagccaacggtcaggatctactcgaagaagccgtgcagctgaagttcataatctctcagaaaggaggaggagagatcggatcaatgaaagaatgaaagctcttcaagaactcatacctcactgcagcagaacagataaagcttcgatattggatgaagcaattgattacttaaaatcacttcaaatgcaactccaagtgatgtggatgggaagtggaatggcggcggcggcagcagcagcagcaagtccgatgatgtttcccggggtacaatcatctccatacattaatcagatggctatgcaaagtcagatgcaattgtctcaattcccggttatgaaccggtccgctccgcagaaccatcccggtttagtatgtcaaaacccggtacagttgcagctccaagcacagaaccaaatcttatcggagcagctcgctaggtacatgggcgggattccccagatgccgccggcgggaaatcagatgcagaccgtgcaacaacaaccagcggacatgttgggatttggatctccggcgggaccgcaaagtcaactgtcggcaccggcgaccaccgacagtcttcatatgggtaaaataggctgacttggcatatagttttcctccgaaattattcttcttacagttggtgattgttatttatttttggtcgcctaagcaagcataaaagctaagtcaaatgtattatagagatctaataagttagtctcatacttataacttatttttaaacagttgaattatagtatcaatcaagtgttgggaacctaaagatcatacatgtgtcaatacttttatatttgttctcaaggttcatcagaaaaacaaaataaaaaggatagactaggcctgcatttgacattatcatgggcttttttgggtctatgaatatgaacattaacccc

SEQ ID NO: 624 - protein, 444 aa, Arabidopsis thaliana
  G789
MEQVFADWNFEDNFHMSTNKRSIRPEDELVELLWRDGQVVLQSQARREPSVQVQTHKQETLRKPNNIFLDNQETVQKPNYAALDDQETVSWIQYPPDDVIDPFESEFSSHFFSSIDHLGGPEKPRTIEETVKHEAQAMAPPKFRSSVITVGPSHCGSNQSTNIHQATTLPVSMSDRSKNVEERLDTSSGGSSGCSYGRNNKETVSGTSVTIDRKRKHVMDADQESVSQSDIGLTSTDDQTMGNKSSQRSGSTRRSRAAEVHNLSERRRRDRINERMKALQELIPHCSRTDKASILDEAIDYLKSLQMQLQVMWMGSGMAAAAAAAASPMMFPGVQSSPYINQMAMQSQMQLSQFPVMNRSAPQNHPGLVCQNPVQLQLQAQNQILSEQLARYMGGIPQMPPAGNQMQTVQQQPADMLGFGSPAGPQSQLSAPATTDSLHMGKIG

SEQ ID NO: 625 - DNA, 2627 bp, Arabidopsis thaliana
  G829
tcctacttgcttcccaaagttgcaatctttgaggatctttgacataaccataaatatcctctggtggatgtgagtaaggttgcattgattccaaggacatggcgatggggaagtattcccgtgtagacgggaagaaatcatcgagctatggtttaaccattaccattgttctgttactttccctctgtttagttgggacatggatgttcatgtcttcttggtcagcccctgctgattctgctggctactcctcaactgatactgctaaagatgtttctaagaatgacttgagaaaagaagaaggcgatcgagatccgaagaacttttctgatgaaaagaatgaagaaaatgaggctgcgactgagaacaaccaagtgaagactgattctgagaactctgctgagggaaaccaggtcaatgagagctctggcgagaaaactgaagctggcgtggaaagaaaagagtctgatgacaacaatggtgatggagatggggagaaagagaagaatgtgaaagaagtaggatccgaaagtgatgaaacaacgcagaaagagaaaacgcaactggaagagagcacagaagaaaataagtccgaggatggtaatggcaacgaagagaaggctgaagagaatgctagtgaaactgaagaaagcacggagaagagtagcaaggaagtctttccagctggtgaccaggctgaaattacaaaagagtcgagcactggagatggagcttggtcaacccaattggttgagtcgcagaacgagaagaaagcacaacagtcctcgatatctaaggaccaaagtagctatggatggaaaacgtgcaatgtgactgctggtccagactacatcccttgccttgacaattggcaggctatcaaaaagcttcatactacaatgcactatgaacatcgcgagcgccattgtcctgaggaatctcctcattgtcttgtgtctctgcctgatggttataagcggtccatcaagtggccaaagagcagggaaaagatctggtacaacaatgttccccacaccaagcttgcagagatcaaggggcatcaaaattgggtgaagatgagtggtgaacatctgacgttccctggtggtggtactcagtttaagaatggtgctcttcattacattgatttcatccaacagtcacatcctgctattgcatggggaaatagaacccgtgttatattggatgtcggatgtggagttgctagctttggtggttaccttttcgaaagagatgtgcttgctttgtcatttgctcccaaagatgagcatgaggcgcaagtgcaattcgcgctggaacgtggtattcctgcaatgttaaacgttatgggaaccaaaagattaccgtttcccggttctgtttttgaccttatccattgtgctcgttgtagagtcccttggcatattgaaggtggtaaacttcttttggaattgaaccgtgctttgaggccgggtggtttctttgtctggtcagcgactccagtctatagaaagaacgaggaagattctggtatatggaaagcaatgtcggaactcacaaaggcaatgtgctggaagctggtgacaattaagaaagacaaactgaatgaggttggtgccgccatataccaaaagccaacttcaaataaatgttacaacaaaagacctcaaaatgagccacctctctgcaaggattccgatgatcaaaatgcagcctggaatgttccacttgaggcatgtatgcataaagtgacagaagattcatcaaagcgaggagcagtgtggccaaacatgtggccagagagggttgaaactgcgcctgagtggttggattcgcaggaaggtgtttatggaaaacctgcaccagaagatttcacagcagaccaagagaagtggaaaactattgtctcaaaggcataccttaatgacatgggaatcgattggtctaatgtgagaaacgtgatggacatgagagcagtctatggaggatttgctgctgcgttgaaggatttgaagttatgggtgatgaacgtggttcctgtggatgcgccagatacacttcccatcatatatgaacgtggtttatttggaatctatcatgactggtgtgaatcattcaacacttatcccagaacttacgaccttctccatgccgatcatcttttctctaccctgaggaagaggtgcaatttggtgtcggtaatggctgagattgatcggattcttaggccacaaggaactttcatcataagggatgacatggaaacattaggagaagttgagaaaatggtgaaatctatgaaatggaaggttaaaatgacgcagtccaaagacaatgaaggcttgctttcaattgaaaagtcatggtggcgtcctgaagaaactgagacaatcaaatcggcaatcgcttaaacaagtcagaaaagaaaagaaaagcatcacttgaatatagttcagtaaaaaagttggttctttcacgcctttaaggcttgcttatcaaattcatttgaccttgtttcttagtagtatttgtatcttttggctttgagaaaagttgtatacataaattctggaatcataccgttagctctcaaaatgtatacaagatgagttttgttttgttctaaa

SEQ ID NO: 626 - protein, 770 aa, Arabidopsis thaliana
  G829
MAMGKYSRVDGKKSSSYGLTITIVLLLSLCLVGTWMFMSSWSAPADSAGYSSTDTAKDVSKNDLRKEEGDRDPKNFSDEKNEENEAATENNQVKTDSENSAEGNQVNESSGEKTEAGVERKESDDNNGDGDGEKEKNVKEVGSESDETTQKEKTQLEESTEENKSEDGNGNEEKAEENASETEESTEKSSKEVFPAGDQAEITKESSTGDGAWSTQLVESQNEKKAQQSSISKDQSSYGWKTCNVTAGPDYIPCLDNWQAIKKLHTTMHYEHRERHCPEESPHCLVSLPDGYKRSIKWPKSREKIWYNNVPHTKLAEIKGHQNWVKMSGEHLTFPGGGTQFKNGALHYIDFIQQSHPAIAWGNRTRVILDVGCGVASFGGYLFERDVLALSFAPKDEHEAQVQFALERGIPAMLNVMGTKRLPFPGSVFDLIHCARCRVPWHIEGGKLLLELNRALRPGGFFVWSATPVYRKNEEDSGIWKAMSELTKAMCWKLVTIKKDKLNEVGAAIYQKPTSNKCYNKRPQNEPPLCKDSDDQNAAWNVPLEACMHKVTEDSSKRGAVWPNMWPERVETAPEWLDSQEGVYGKPAPEDFTADQEKWKTIVSKAYLNDMGIDWSNVRNVMDMRAVYGGFAAALKDLKLWVMNVVPVDAPDTLPIIYERGLFGIYHDWCESFNTYPRTYDLLHADHLFSTLRKRCNLVSVMAEIDRILRPQGTFIIRDDMETLGEVEKMVKSMKWKVKMTQSKDNEGLLSIEKSWWRPEETETIKSAIA

SEQ ID NO: 627 - DNA, 1747 bp, Arabidopsis thaliana
  G864
tgcaaaaacattttcttgtctctcctctgcccaaattttttttctttccaggaatatttcctagaaaaacccaagcaaagctttaaccccttcctcctccaaaagtagcatcttcctctttttctatttctcctttcctcttcttatctctctctcgtttgtgaacgattccttaagaatataaccaaaagcccttttctcctttcttcaactttccgggaaaaatcttcacgcagcaaggtttctctctcggctctcgcagtgtttttcgggccttttgttctttctataaaaaaaaaattcgcgtcctttaagaaaactttttccacctagagaagaagaagagtatcactcttgttgttcaagtttctctctttaataaaaaatccatctttattctttgtcttctttcctttttgctttccctaatctctatgttataaacacacagagagaaacaaagtcacagtctcgagtcaaaaacagagaatacgaaagaaaaatggaagcggagaagaaaatggttctaccgagaatcaaattcacagagcacaaaaccaacacgacaacaatcgtatcggagttaaccaacactcaccaaaccaggattcttcgtatctcagtcactgacccagacgctactgattcctccagtgacgacgaagaagaagaacatcaacgctttgtctctaaacgccgtcgtgttaagaagtttgtcaacgaagtctatctcgattccggtgctgttgttactggtagttgtggtcaaatggagtcgaagaagagacaaaagagagcggttaaatcggagtctactgtttctccggttgtttcagcgacgacgactacgacgggagagaagaagttccgaggagtgagacagcgtccatggggaaaatgggcggcggagataagagatccgttgaaacgtgtacggctctggttaggtacttacaacacggcggaagaagctgctatggtttacgataacgccgctattcagcttcgtggtcccgacgctctgactaatttctcagtcactccgacaacagcgacggagaagaaagccccaccaccgtctccggtgaagaagaagaagaagaaaaacaacaaaagcaaaaaatccgttactgcttcttcctccatcagcagaagcagcagcaacgattgtctctgctctccggtgtctgttctccgatctcctttcgccgtcgacgaattctccggcatttcttcatcaccagtcgcggccgttgtagtcaaggaagagccatccatgacaacggtatctgaaactttctctgatttctcggcgcccttgttctcagatgatgacgtgttcgatttccggagctcagtggttcccgactatctcggcggcgatttatttggggaagatctattcacggcggatatgtgtacggatatgaacttcggattcgatttcggatccggattatccagctggcacatggaggaccattttcaagatatcggggatctattcgggtcggatcctcttttagctgtttaataatattttaaataaataaatagttataccggccgttactaaacggaaccggagaaagttttgtataccggtgacataaaatctcggttatgttcgtaatctttttttctttgttatatataaaaatatgaatgaaactgaattaatgtaagttaatggtgataattattaacgttttaagttttgaaaaaaaaaaaaaaaaaaaaaaaaaaa

SEQ ID NO: 628 - protein, 343 aa, Arabidopsis thaliana
  G864
MEAEKKMVLPRIKFTEHKTNTTTIVSELTNTHQTRILRISVTDPDATDSSSDDEEEEHQRFVSKRRRVKKFVNEVYLDSGAVVTGSCGQMESKKRQKRAVKSESTVSPVVSATTTTTGEKKFRGVRQRPWGKWAAEIRDPLKRVRLWLGTYNTAEEAAMVYDNAAIQLRGPDALTNFSVTPTTATEKKAPPPSPVKKKKKKNNKSKKSVTASSSISRSSSNDCLCSPVSVLRSPFAVDEFSGISSSPVAAVVVKEEPSMTTVSETFSDFSAPLFSDDDVFDFRSSVVPDYLGGDLFGEDLFTADMCTDMNFGFDFGSGLSSWHMEDHFQDIGDLFGSDPLLAV

SEQ ID NO: 629 - DNA, 1281 bp, Arabidopsis thaliana
  G867
cacaacacaaacacatttctgttttctccattgtttcaaaccataaaaaaaaacacagattaaatggaatcgagtagcgttgatgagagtactacaagtacaggttccatctgtgaaaccccggcgataactccggcgaaaaagtcgtcggtaggtaacttatacaggatgggaagcggatcaagcgttgtgttagattcagagaacggcgtagaagctgaatctaggaagcttccgtcgtcaaaatacaaaggtgtggtgccacaaccaaacggaagatggggagctcagatttacgagaaacaccagcgcgtgtggctcgggacattcaacgaagaagacgaagccgctcgtgcctacgacgtcgcggttcacaggttccgtcgccgtgacgccgtcacaaatttcaaagacgtgaagatggacgaagacgaggtcgatttcttgaattctcattcgaaatctgagatcgttgatatgttgaggaaacatacttataacgaagagttagagcagagtaaacggcgtcgtaatggtaacggaaacatgactaggacgttgttaacgtcggggttgagtaatgatggtgtttctacgacggggtttagatcggcggaggcactgtttgagaaagcggtaacgccaagcgacgttgggaagctaaaccgtttggttataccgaaacatcacgcagagaaacattttccgttaccgtcaagtaacgtttccgtgaaaggagtgttgttgaactttgaggacgttaacgggaaagtgtggaggttccgttactcgtattggaacagtagtcagagttatgttttgactaaaggttggagcaggttcgttaaggagaagaatctacgtgctggtgacgtggttagtttcagtagatctaacggtcaggatcaacagttgtacattgggtggaagtcgagatccgggtcagatttagatgcgggtcgggttttgagattgttcggagttaacatttcaccggagagttcaagaaacgacgtcgtaggaaacaaaagagtgaacgatactgagatgttatcgttggtgtgtagcaagaagcaacgcatctttcacgcctcgtaacaactcttcttctttttttttcttttgttgttttaataatttttaaaaactccattttcgttttctttatttgcatcggtttctttcttcttgtttaccaaaggttcatgagttgtttttgttgtattgatgaactgtaaattttatttataggataaattttaaaaaaaaaaaaaaaaaaaa

SEQ ID NO: 630 - protein, 344 aa, Arabidopsis thaliana
  G867
MESSSVDESTTSTGSICETPAITPAKKSSVGNLYRMGSGSSVVLDSENGVEAESRKLPSSKYKGVVPQPNGRWGAQIYEKHQRVWLGTFNEEDEAARAYDVAVHRFRRRDAVTNFKDVKMDEDEVDFLNSHSKSEIVDMLRKHTYNEELEQSKRRRNGNGNMTRTLLTSGLSNDGVSTTGFRSAEALFEKAVTPSDVGKLNRLVIPKHHAEKHFPLPSSNVSVKGVLLNFEDVNGKVWRFRYSYWNSSQSYVLTKGWSRFVKEKNLRAGDVVSFSRSNGQDQQLYIGWKSRSGSDLDAGRVLRLFGVNISPESSRNDVVGNKRVNDTEMLSLVCSKKQRIFHAS

SEQ ID NO: 631 - DNA, 1195 bp, Arabidopsis thaliana
  G883
ctctctcgtcttcgtcttcttcttcttcaacgttcctctccaaaatcctcagaccaagaaatcatcatggccgtcgatctaatgcgtttccctaagatagatgatcaaacggctattcaggaagctgcatcgcaaggtttacaaagtatggaacatctgatccgtgtcctctctaaccgtcccgaacaacaacacaacgttgactgctccgagatcactgacttcaccgtttctaaattcaaaaccgtcatttctctccttaaccgtactggtcacgctcggttcagacgcggaccggttcactccacttcctctgccgcatctcagaaactacagagtcagatcgttaaaaatactcaacctgaggctccgatagtgagaacaactacgaatcaccctcaaatcgttcctccaccgtctagtgtaacactcgatttctctaaaccaagcatcttcggcaccaaagctaagagcgccgagctggaattctccaaagaaaacttcagtgtttctttaaactcctcattcatgtcgtcggcgataaccggagacggcagcgtctccaatggaaaaatcttccttgcttctgctccgtcgcagcctgttaactcttccggaaaaccaccgttggctggtcatccttacagaaagagatgtctcgagcatgagcactcagagagtttctccggaaaagtctccggctccgcctacggaaagtgccattgcaagaaaaggaaaaatcggatgaagagaaccgtgagagtaccggcgataagtgcaaagatcgccgatattccaccggacgaatattcgtggaggaagtacggacaaaaaccgatcaagggctcaccacacccacgtggttactacaagtgcagtacattcagaggatgtccagcgaggaaacacgtggaacgagcattagatgatccagcgatgcttattgtgacatacgaaggagagcaccgtcataaccaatccgcgatgcaggagaatatttcttcttcaggcattaatgatttagtgtttgcctcggcttgacttttttttgtactatttgttttttgattttttgagtactttagatggattgaaatttgtaaatttttttattaagaaatcaatttaaatagagaaaaattagtggtggtgcaaaaaaaaaaaaaaaaaaaaaaaaaaaaaaaaaaaaaaaaaa

SEQ ID NO: 632 - protein, 324 aa, Arabidopsis thaliana
  G883
MAVDLMRFPKIDDQTAIQEAASQGLQSMEHLIRVLSNRPEQQHNVDCSEITDFTVSKFKTVISLLNRTGHARFRRGPVHSTSSAASQKLQSQIVKNTQPEAPIVRTTTNHPQIVPPPSSVTLDFSKPSIFGTKAKSAELEFSKENFSVSLNSSFMSSAITGDGSVSNGKIFLASAPSQPVNSSGKPPLAGHPYRKRCLEHEHSESFSGKVSGSAYGKCHCKKRKNRMKRTVRVPAISAKIADIPPDEYSWRKYGQKPIKGSPHPRGYYKCSTFRGCPARKHVERALDDPAMLIVTYEGEHRHNQSAMQENISSSGINDLVFASA

SEQ ID NO: 633 - DNA, 1177 bp, Arabidopsis thaliana
  G914
ctttttcttccctgttttagatagactcttagagtctctctagagtcaccggaacaatcacaaaagcgacgacatattactcattcctacaaatactcatgttggacctcaacctcggaatcttgtcgacacacaacgaagatgaagattgcaaagtaccaacttccatcttcattcaagaagaagattccattaatccctcaaacgacaacttgtctttgattacatttggaatccttaaacgaaacgtcgaaatccttcctcctccccctcctcctcctcctcctcctcctccttcggaaaatgaactctccggccccggaaatgagtggttggatctttcgtcgatgcaaagaaataaacaagaaacgttggtgatgaagaaaaaaagtcgacgtggcccaagatcaagaagctctcattatcgtggcgttaccttttaccgtcgaaccggccgttgggaatctcatatttgggactgtggaaaacaagtttatttgggtggtttcgacacagcctacacagccgcaagagcgtacgaccgagctgctatcagattccggggactccaagcagatatcaactttatcgtggatgattacaaacaagacattgaaaagatgaagaatttaagcaaagaagagtttgtgcaatctcttagacgagcgagtgcaagcttagcaagaggaggttctaaatacaaaaacacccatatgagaaatgatcacatccatctcttccaaaacaggggattgaatgcagcagcagcaaaatgcaatgagataagaaagatggaaggggatattaagttgggtgcccatagtaaaggaaatgagcacaacgatctcgagctaagtcttgggatatcttcatcgtcaaaagttagaattttggaaccagcagattattacatgggtttgaatcgatcggtgacgagtttgcatgggaagccgttgccgggatatctaccgatcacagaaattaaaccgttaaagacagttgtagcatcatcaggattccctttcattaccatgatcaatccttcttctttgtccttatcttgttttgatccatgaggtgatcactatttacttttaaaattttcccctttttattgataatctattgaatgacggaatgattatgtgacttatatctttttataaaccatattctt

SEQ ID NO: 634 - protein, 325 aa, Arabidopsis thaliana
  G914
MLDLNLGILSTHNEDEDCKVPTSIFIQEEDSINPSNDNLSLITFGILKRNVEILPPPPPPPPPPPPSENELSGPGNEWLDLSSMQRNKQETLVMKKKSRRGPRSRSSHYRGVTFYRRTGRWESHIWDCGKQVYLGGFDTAYTAARAYDRAAIRFRGLQADINFIVDDYKQDIEKMKNLSKEEFVQSLRRASASLARGGSKYKNTHMRNDHIHLFQNRGLNAAAAKCNEIRKMEGDIKLGAHSKGNEHNDLELSLGISSSSKVRILEPADYYMGLNRSVTSLHGKPLPGYLPITEIKPLKTVVASSGFPFITMINPSSLSLSCFDP

SEQ ID NO: 635 - DNA, 1077 bp, Arabidopsis thaliana
  G957
atggctgataataaggtcaatctttcgattaatggacaatcaaaagtgcctccaggtttcagattccatcccaccgaagaagaacttctccattactatctccgtaagaaagttaactctcaaaagatcgatcttgatgtcattcgtgaagttgatctaaacaagcttgagccttgggatattcaagaggaatgtagaatcggttcaacgccacaaaacgactggtacttcttcagccacaaggacaagaagtatccaaccgggaccaggacgaaccgggcaacagtcgctggattctggaaagctaccggacgtgacaaaatcatctgcagttgtgtccggagaattggactgaggaagacactcgtgttctacaaaggaagagctcctcacggtcagaaatccgactggatcatgcatgagtatcgcctcgacgatactccaatgtctaatggctatgctgatgttgttacagaagatccaatgagctataacgaagaaggttgggtggtatgtcgagtgttcaggaagaagaactatcaaaagattgacgattgtcctaaaatcactctatcttctttacctgatgacacggaggaagagaaggggcccacctttcacaacactcaaaacgttaccggtttagaccatgttcttctctacatggaccgtaccggttctaacatttgcatgcccgagagccaaacaacgactcaacatcaagatgatgtcttattcatgcaactcccaagtcttgagacacctaaatccgagagcccggtcgaccaaagtttcctgactccaagcaaactcgatttctctcccgttcaagagaagataaccgaaagaccggtttgcagcaactgggctagtcttgaccggctcgtagcttggcaattgaacaatggtcatcataatccgtgtcatcgtaagagttttgatgaagaagaagaaaatggtgatactatgatgcagcgatgggatcttcattggaataatgatgataatgttgatctttggagtagtttcactgagtcttcttcgtctttagacccacttcttcatttatctgtatga

SEQ ID NO: 636 - protein, 358 aa, Arabidopsis thaliana
  G957
MADNKVNLSINGQSKVPPGFRFHPTEEELLHYYLRKKVNSQKIDLDVIREVDLNKLEPWDIQEECRIGSTPQNDWYFFSHKDKKYPTGTRTNRATVAGFWKATGRDKIICSCVRRIGLRKTLVFYKGRAPHGQKSDWIMHEYRLDDTPMSNGYADVVTEDPMSYNEEGWVVCRVFRKKNYQKIDDCPKITLSSLPDDTEEEKGPTFHNTQNVTGLDHVLLYMDRTGSNICMPESQTTTQHQDDVLFMQLPSLETPKSESPVDQSFLTPSKLDFSPVQEKITERPVCSNWASLDRLVAWQLNNGHHNPCHRKSFDEEEENGDTMMQRWDLHWNNDDNVDLWSSFTESSSSLDPLLHLSV

SEQ ID NO: 637 - DNA, 1095 bp, Arabidopsis thaliana
  G961
atgtcaaaatctatgagcatatcagtgaacggacaatctcaagtgcctcctgggtttaggtttcatccgaccgaggaagagctgttgcagtattatctccggaagaaagttaatagcatcgagatcgatcttgatgtcattcgcgacgttgatctcaacaagctcgagccttgggacattcaagagatgtgtaaaataggaacaacgccacaaaacgactggtatttctttagccacaaggacaaaaaatatccgacgggaacgagaactaacagagccactgcggctggattttggaaagcaactggccgcgacaagatcatatatagcaatggccgtagaattgggatgagaaagactcttgttttctacaaaggccgagctcctcacggccaaaaatctgattggatcatgcatgaatatagactcgatgacaacattatttcccccgaggatgtcaccgttcatgaggtcgtgagtattataggggaagcatcacaagacgaaggatgggtggtgtgtcgtattttcaagaagaagaatcttcacaaaaccctaaacagtcccgtcggaggagcttccctgagcggcggcggagatacgccgaagacgacatcatctcagatcttcaacgaggatactctcgaccaatttcttgaacttatggggagatcttgtaaagaagagctaaatcttgaccctttcatgaaactcccaaacctcgaaagccctaacagtcaggcaatcaacaactgccacgtaagctctcccgacactaatcataatatccacgtcagcaacgtggtcgacactagctttgttactagctgggcggctttagaccgcctcgtggcctcgcagcttaacggacccacatcatattcaattacagccgtcaatgagagccacgtgggccatgatcatctcgctttgccttccgtccgatctccgtaccccagcctaaaccggtccgcttcgtaccacgccggtttaacacaggaatatacaccggagatggagctatggaatacgacgacgtcgtctctatcgtcatcgcctggcccattttgtcacgtgtcgaatggtagtggataa

SEQ ID NO: 638 - protein, 364 aa, Arabidopsis thaliana
  G961
MSKSMSISVNGQSQVPPGFRFHPTEEELLQYYLRKKVNSIEIDLDVIRDVDLNKLEPWDIQEMCKIGTTPQNDWYFFSHKDKKYPTGTRTNRATAAGFWKATGRDKIIYSNGRRIGMRKTLVFYKGRAPHGQKSDWIMHEYRLDDNIISPEDVTVHEVVSIIGEASQDEGWVVCRIFKKKNLHKTLNSPVGGASLSGGGDTPKTTSSQIFNEDTLDQFLELMGRSCKEELNLDPFMKLPNLESPNSQAINNCHVSSPDTNHNIHVSNVVDTSFVTSWAALDRLVASQLNGPTSYSITAVNESHVGHDHLALPSVRSPYPSLNRSASYHAGLTQEYTPEMELWNTTTSSLSSSPGPFCHVSNGSG

SEQ ID NO: 639 - DNA, 1239 bp, Arabidopsis thaliana
  G993
caaatatggaatacagctgtgtagacgacagtagtacaacgtcagaatctctctccatctctactactccaaagccgacaacgacgacggagaagaaactctcttctccgccggcgacgtcgatgcgtctctacagaatgggaagcggcggaagcagcgtcgttttggattcagagaacggcgtcgagaccgagtcacgtaagcttccttcgtcgaaatataaaggcgttgtgcctcagcctaacggaagatggggagctcagatttacgagaagcatcagcgagtttggctcggtactttcaacgaggaagaagaagctgcgtcttcttacgacatcgccgtgaggagattccgcggccgcgacgccgtcactaacttcaaatctcaagttgatggaaacgacgccgaatcggcttttcttgacgctcattctaaagctgagatcgtggatatgttgaggaaacacacttacgccgatgagtttgagcagagtagacggaagtttgttaacggcgacggaaaacgctctgggttggagacggcgacgtacggaaacgacgctgttttgagagcgcgtgaggttttgttcgagaagactgttacgccgagcgacgtcgggaagctgaaccgtttagtgataccgaaacaacacgcggagaagcattttccgttaccggcgatgacgacggcgatggggatgaatccgtctccgacgaaaggcgttttgattaacttggaagatagaacagggaaagtgtggcggttccgttacagttactggaacagcagtcaaagttacgtgttgaccaagggctggagccggttcgttaaagagaagaatcttcgagccggtgatgtggtttgtttcgagagatcaaccggaccagaccggcaattgtatatccactggaaagtccggtctagtccggttcagactgtggttaggctattcggagtcaacattttcaatgtgagtaacgagaaaccaaacgacgtcgcagtagagtgtgttggcaagaagagatctcgggaagatgatttgttttcgttagggtgttccaagaagcaggcgattatcaacatcttgtgacaaattctttttttttggtttttttcttcaatttgtttctcctttttcaatattttgtattgaaatgacaagttgtaaattaggacaagacaagaaaaaatgacaactagacaaaatagtttttgtttaaaaaaaaaaaaaaaaaaaa

SEQ ID NO: 640 - protein, 361 aa, Arabidopsis thaliana
  G993
MEYSCVDDSSTTSESLSISTTPKPTTTTEKKLSSPPATSMRLYRMGSGGSSVVLDSENGVETESRKLPSSKYKGVVPQPNGRWGAQIYEKHQRVWLGTFNEEEEAASSYDIAVRRFRGRDAVTNFKSQVDGNDAESAFLDAHSKAEIVDMLRKHTYADEFEQSRRKFVNGDGKRSGLETATYGNDAVLRAREVLFEKTVTPSDVGKLNRLVIPKQHAEKHFPLPAMTTAMGMNPSPTKGVLINLEDRTGKVWRFRYSYWNSSQSYVLTKGWSRFVKEKNLRAGDVVCFERSTGPDRQLYIHWKVRSSPVQTVVRLFGVNIFNVSNEKPNDVAVECVGKKRSREDDLFSLGCSKKQAIINIL

SEQ ID NO: 641 - DNA, 803 bp, Arabidopsis thaliana
  G1011
cttgtttagggtttcaatctttacagatcttgtggcagaaaaaatcaagtcaaagcaagaaaaatggttagaggaaagatagagatgaagaaaatagaaaacgcaacgagtagacaagtgactttctcaaaaagaagaaatggtttgttgaagaaagcttatgagctctcagtactctgcgatgctcaactctctctcatcatcttctcccagagaggaaggctttatgaattctctagctctgatatgcagaagacgatcgaacgctaccgcaagtacacaaaagatcatgaaaccagcaatcacgactcacaaattcacttgcagcaattgaaacaagaagcaagccacatgataacaaagattgaactccttgagtttcacaagcggaagctattgggacaaggaattgcttcttgttctctagaagagcttcaagaaatcgatagtcaactccaaagaagtctgggaaaggtccgagaaagaaaggctcaattgttcaaggagcagttggagaaactaaaagcaaaggagaaacaattgttagaagagaacgtcaagttacatcaaaagaatgttattaatccatggagaggatcatcgactgatcagcagcaagagaaatacaaagttatagatttgaatttggaagttgaaactgacttattcatcggtttgccaaatagaaactgctagtaacattatataatatgtttatttatttatcatgaaatattcaaaatcattcaataaattgtgaggtaatgatttgggatagtaaaaaaaaaaaaaaaaaaaaaaaa

SEQ ID NO: 642 - protein, 210 aa, Arabidopsis thaliana
  G1011
MVRGKIEMKKIENATSRQVTFSKRRNGLLKKAYELSVLCDAQLSLIIFSQRGRLYEFSSSDMQKTIERYRKYTKDHETSNHDSQIHLQQLKQEASHMITKIELLEFHKRKLLGQGIASCSLEELQEIDSQLQRSLGKVRERKAQLFKEQLEKLKAKEKQLLEENVKLHQKNVINPWRGSSTDQQQEKYKVIDLNLEVETDLFIGLPNRNC

SEQ ID NO: 643 - DNA, 869 bp, Arabidopsis thaliana
  G1065
cggacgcgtgggtttggttttcttttttcctctctatttcttcggctgagaggcggcgactatggcggaggaacagaagatagcgttagaatcagaatctccggcgaaggttacgactcctgctccagcagatacaccggctccagctccggcagagattccggctccagctccagctccgactccggctgatgtcacgaaagacgttgcagaggagaaaattcaaaacccacctccggagcaaattttcgatgactccaaagcccttactgttgttgagaaacctgtagaagagcctgcaccggcgaaacctgcgtctgcatcgctcgatagagatgttaagctagctgatttgtcaaaggaaaagagattgtctttcgtcagagcgtgggaagaaagcgaaaagagcaaagcagagaacaaagctgagaagaagattgcagatgttcatgcttgggaaaacagcaagaaagcagctgtcgaagcgcaactcaagaaaatcgaggagcaactagagaagaagaaagcagagtatgcagagaggatgaagaataaggttgcagcgattcacaaggaagcagaagagagaagagcaatgattgaagctaagcgtggagaagacgttcttaaagcagaagaaacggctgctaaatacagagccactggaattgttccaaaggcaacttgtggatgtttctaatcttgaatttgcgaatcaaagtttcaagacttcgtaactgtaaagtgtaatcaaatttctctgttctctttaatggcttgtaatgttgtttgtatattgattttgtgtgtgacaatcagagtgaaaaatatgtttcattgttttctaaaaaaaaaaaaaaaaaaaaaaa

SEQ ID NO: 644 - protein, 212 aa, Arabidopsis thaliana
  G1065
MAEEQKIALESESPAKVTTPAPADTPAPAPAEIPAPAPAPTPADVTKDVAEEKIQNPPPEQIFDDSKALTVVEKPVEEPAPAKPASASLDRDVKLADLSKEKRLSFVRAWEESEKSKAENKAEKKIADVHAWENSKKAAVEAQLKKIEEQLEKKKAEYAERMKNKVAAIHKEAEERRAMIEAKRGEDVLKAEETAAKYRATGIVPKATCGCF

SEQ ID NO: 645 - DNA, 1668 bp, Arabidopsis thaliana
  G1071
gagagagtctgttagaggttttttgtttgtttctgtttccttctgtcacccagaaaactaaaaagcaaacaaattcaagaagagagagagagagagatagcctcaaaaccaagtcctaaccattgttgatagaagagaaagcttttcttttcttgttgcttatggtgaaaaatgaaagagagagaggaggagaagtaagaagcagagaaagtgtttagagctttgcatgttcctttctctccaagtttatatcttcatcggtttcacaagttcacttaaaaagttgaaaagagtctttcttcttcaactattgtaaatgcgaaatggatcgaagagatgcaatgggattatccgggtcaggttcttactatatccatagaggattatccgggtcgggtcctccaacgtttcatggatcaccacagcaacagcaaggtcttcgtcacttacctaatcaaaactctccattcgggtcaggctccactggtttcggatctccttctttacacggtgatccttctctggcaacagcagccggaggagccggagctcttcctcatcatatcggcgttaatatgattgctcctcctccacctcccagtgaaactccgatgaaacgaaagagaggacggcctagaaaatacggtcaagacggctctgtttctttggctctgtcgtcttcctctgtttcgaccattactcccaacaactctaacaaacgcggccgtggtcgacctccgggctccggcaagaaacagagaatggcttccgttggtgaactgatgccttcatcttctggaatgagcttcacgccacatgttatcgcggtttcaataggagaagatattgcatcaaaggttatagctttctctcaacaaggtccgagagccatttgcgttttatctgcaagtggtgcagtctctactgcaacacttattcaaccatcagcatctcccggagccattaaatacgagggccggtttgaaatcctagcgttatcaacatcttatatagtggcaactgatggaagcttccgtaaccgaactggaaacttatcggtttcgcttgctagccccgatgggcgtgtgattggcggtgccattggtgggcctttaatagctgcaagtcctgttcaggttattgtagggagctttatatgggcagctccaaagatcaagagcaagaaacgagaagaagaagcttctgaagttgttcaagaaactgatgatcaccacgttctggacaataataacaacacgatttcgcctgtccctcagcagcagccaaaccaaaacctgatttggtcaacaggttcaaggcaaatggatatgcgtcatgctcatgctgatattgatttaatgcgcggttgatgatagcgagaaagaactctgtgtatataaagcatggaatctaggaagaagaagaaggaatataagctaacctctgaacaaaagtatgtggaaatgttagggaaaaagattatgtggaaatgttagggaaaaagattaactctattagtgtacctctcatatctctaagcttgtttggttttactgtttctgtgactctgaagatttgcagagttcctttctttctctgttttagattgttcagtctttatgtaatttgcttgcaattctgattctacagcttagattccaaaaaaaa

SEQ ID NO: 646 - protein, 348 aa, Arabidopsis thaliana
  G1071
MDRRDAMGLSGSGSYYIHRGLSGSGPPTFHGSPQQQQGLRHLPNQNSPFGSGSTGFGSPSLHGDPSLATAAGGAGALPHHIGVNMIAPPPPPSETPMKRKRGRPRKYGQDGSVSLALSSSSVSTITPNNSNKRGRGRPPGSGKKQRMASVGELMPSSSGMSFTPHVIAVSIGEDIASKVIAFSQQGPRAICVLSASGAVSTATLIQPSASPGAIKYEGRFEILALSTSYIVATDGSFRNRTGNLSVSLASPDGRVIGGAIGGPLIAASPVQVIVGSFIWAAPKIKSKKREEEASEVVQETDDHHVLDNNNNTISPVPQQQPNQNLIWSTGSRQMDMRHAHADIDLMRG

SEQ ID NO: 647 - DNA, 911 bp, Arabidopsis thaliana
  G1277
attctaaagtcctcctctcggaaagtaagagactcaacttccgagccgccatggacgccggagtagcagtaaaagctgacgtggcagtcaaaatgaagagagaaagaccattcaaagggatcagaatgagaaaatgggggaaatgggttgcggagattcgagaacccaacaagcgttcaagactttggctcggctcttactctactcccgaagcggcggcgcgtgcatacgacacggctgtcttttacctcagaggaccaactgctacgctcaacttcccggagcttctgccgtgtacctccgccgaggatatgtcagcggcaacgatcaggaaaaaggcgacggaggtgggagctcaagtagatgcgataggggcgacggtggtgcagaacaacaaacgccgccgcgtttttagtcaaaagcgtgactttggcggcgggttattagagcttgttgacttgaacaagttacctgacccggaaaatctcgatgatgatttggtgggaaaatagactgaaaaataataataaaatatcttacaatggtggctgtagctatcgtacgcggaatgcttgggcttgtgttatatgactacgtggttacggaaagattcctctgtttcgtcattgtattaaaatttaatcccacaagtcaaacatactgtacattattcttaatttagtattttcttattaatatctatcatttgtttggtgaacaccagaatattagactattaatgtaacgagtttttaatatttcgatcataataacaccaagctagttaaaggttaatatcttgttacgaagtcttgagtaagttcaattgtcatatatatgtaacggaagaggttcgttcgggtcccaagtgaagtggatcaaaggtgacttcacataaaaaataaaaaaaa

SEQ ID NO: 648 - protein, 153 aa, Arabidopsis thaliana
  G1277
MDAGVAVKADVAVKMKRERPFKGIRMRKWGKWVAEIREPNKRSRLWLGSYSTPEAAARAYDTAVFYLRGPTATLNFPELLPCTSAEDMSAATIRKKATEVGAQVDAIGATVVQNNKRRRVFSQKRDFGGGLLELVDLNKLPDPENLDDDLVGK

SEQ ID NO: 649 - DNA, 912 bp, Arabidopsis thaliana
  G1309
cgtcgacctcttaattaagacgacttgagagagaaagaaagatacgtggaagatgaccaaatctggagagagaccaaaacagagacagaggaaagggttatggtcacctgaagaagaccagaagctcaagagtttcatcctctctcgtggccatgcttgctggaccactgttcccatcctagctggattgcaaaggaatgggaaaagctgcagattaaggtggattaattacctaagaccaggactaaagagggggtcgtttagtgaagaagaagaagagaccatcttgactttacattcttccttgggtaacaagtggtctcggattgcaaaatatttaccgggaagaacagacaacgagattaagaactattggcattcctatctgaagaagagatggctcaaatctcaaccacaactcaaaagccaaatatcagacctcacagaatctccttcttcactactttcttgcgggaaaagaaatctggaaaccgaaaccctagatcacgtgatctccttccagaaattttcagagaatccaacttcatcaccatccaaagaaagcaacaacaacatgatcatgaacaacagtaataacttgcctaaactgttcttctctgagtggatcagttcttcaaatccacacatcgattactcctctgcttttacagattccaagcacattaatgaaactcaagatcaaatcaatgaagaggaagtgatgatgatcaataacaacaactactcttcacttgaggatgtcatgctccgtacagattttttgcagcctgatcatgaatatgcaaattattattcttctggagatttcttcatcaacagtgaccaaaattatgtctaagaagagtgaatatgatcgtaagaggaacataagctagttacttgtgttacagc

SEQ ID NO: 650 - protein, 268 aa, Arabidopsis thaliana
  G1309
MTKSGERPKQRQRKGLWSPEEDQKLKSFILSRGHACWTTVPILAGLQRNGKSCRLRWINYLRPGLKRGSFSEEEEETILTLHSSLGNKWSRIAKYLPGRTDNEIKNYWHSYLKKRWLKSQPQLKSQISDLTESPSSLLSCGKRNLETETLDHVISFQKFSENPTSSPSKESNNNMIMNNSNNLPKLFFSEWISSSNPHIDYSSAFTDSKHINETQDQINEEEVMMINNNNYSSLEDVMLRTDFLQPDHEYANYYSSGDFFINSDQNYV

SEQ ID NO: 651 - DNA, 1630 bp, Arabidopsis thaliana
  G1337
aatggatttgtcatcattcttctcaccgtccttagtctctgaaaataaattctgattttgatttcgaattttagggattttgagagagagtcagttatgagtagttcggagagagtaccgtgcgatttctgcggcgagcgtacggcggttttgttttgtagagccgatacggcgaagctgtgtttgccttgtgatcagcaagttcacacggcgaatctgttgtcgaggaagcacgtgcgatctcagatctgcgataattgcggtaacgagccagtctctgttcggtgtttcaccgataatctgattttgtgtcaggagtgtgattgggatgttcacggaagttgttcagtttccgatgctcatgttcgatccgccgtggaaggtttttccggttgtccatcggcgttggagcttgctgctttatggggacttgatttggagcaagggaggaaagatgaagagaatcaagttccgatgatggcgatgatgatggataatttcgggatgcagttggattcttgggttttgggatctaatgaattgattgttcccagcgatacgacgtttaagaagcgtggatcttgtggatctagttgtgggaggtataagcaggtattgtgtaagcagcttgaggagttgcttaagagtggtgttgtcggtggtgatggcgatgatggtgatcgtgaccgtgattgtgaccgtgagggtgcttgtgatggagatggagatggagaagcaggagaggggcttatggttccggagatgtcagagagattgaaatggtcaagagatgttgaggagatcaatggtggcggaggaggaggagttaaccagcagtggaatgctactactactaatcctagtggtggccagagttctcagatatgggattttaacttgggacagtcacggggacctgaggatacgagtcgagtggaagctgcatatgtagggaaaggtgctgcttcttcattcacaatcaacaattttgttgaccatatgaatgaaacttgttccactaatgtgaaaggtgtcaaagagattaaaaaggatgactacaagcgatcaacttcaggccaggtacaaccaacaaaatctgagagcaacaatcgtccaattacctttggctctgagaaaggttcgaactcctccagtgacttgcatttcacagagcatattgctggaactagttgtaagaccacaagactagttgcaactaaggctgatctggagcggctggctcagaacagaggagatgcaatgcagcgttacaaggaaaagaggaagacacggagatatgataagaccataaggtatgaatcgaggaaggcaagagctgacactaggttgcgtgtcagaggcagatttgtgaaagctagtgaagctccttacccttaaccttaagttttttcacataggcttccttttagctacaaacttagttactttttttactccactgcctcataaatgtacagaccggtctcgtttcatctggccgcccttcttgttttattgccttatctggcccttttatgtaccttggaatcttatctagtttaaaaaagattgtaaccttctagaaaaccatattctgttgacagtatatacatgtctatccaagcaaaaa

SEQ ID NO: 652 - protein, 433 aa, Arabidopsis thaliana
  G1337
MSSSERVPCDFCGERTAVLFCRADTAKLCLPCDQQVHTANLLSRKHVRSQICDNCGNEPVSVRCFTDNLILCQECDWDVHGSCSVSDAHVRSAVEGFSGCPSALELAALWGLDLEQGRKDEENQVPMMAMMMDNFGMQLDSWVLGSNELIVPSDTTFKKRGSCGSSCGRYKQVLCKQLEELLKSGVVGGDGDDGDRDRDCDREGACDGDGDGEAGEGLMVPEMSERLKWSRDVEEINGGGGGGVNQQWNATTTNPSGGQSSQIWDFNLGQSRGPEDTSRVEAAYVGKGAASSFTINNFVDHMNETCSTNVKGVKEIKKDDYKRSTSGQVQPTKSESNNRPITFGSEKGSNSSSDLHFTEHIAGTSCKTTRLVATKADLERLAQNRGDAMQRYKEKRKTRRYDKTIRYESRKARADTRLRVRGRFVKASEAPYP

SEQ ID NO: 653 - DNA, 839 bp, Arabidopsis thaliana
  G1379
ctctgcctctctctctctctcaaaacccatctcgaaagtctttctctttcgagggtttagatcctccatggaaggcggcggagttgctgacgtggctgtccccggtacgaggaagagagacagaccttacaaaggaattaggatgaggaagtggggaaagtgggtggcggagattcgtgagcctaacaagcgctctaggttatggcttggctcttactctactcccgaggcggcggcgcgagcttacgacacggcggttttctatcttagaggacctacggcgaggcttaacttccctgagcttcttcctggggagaaattctccgacgaggatatgtcggctgcgaccatcaggaagaaagccacggaggtcggtgctcaggttgatgctttgggcacggcggtgcaaaataaccgccaccgtgtttttggtcagaatcgagatagtgatgtggataataagaattttcatcggaattatcaaaacggtgaacgagaagaagaagaagaagatgaggatgacaagagattgaggagtggcggccggttattggatcgggttgacttgaataaattacccgacccggaaagctccgatgaagaatgggaaagcaaacattaaaaatatatagtttggagcggtggctgttgctaacgtacgccaacggcttgcttctacgaatcattagcgccgtttatgatttttttttttttttttttcattatctgaaaatttagggctttttagttattaatttttgttttgtttttttcctttcttgcgagttttgcggtttatggaattttaggctattgcttaacgaaaaaaaaaaaaaaaa

SEQ ID NO: 654 - protein, 184 aa, Arabidopsis thaliana
  G1379
MEGGGVADVAVPGTRKRDRPYKGIRMRKWGKWVAEIREPNKRSRLWLGSYSTPEAAARAYDTAVFYLRGPTARLNFPELLPGEKFSDEDMSAATIRKKATEVGAQVDALGTAVQNNRHRVFGQNRDSDVDNKNFHRNYQNGEREEEEEDEDDKRLRSGGRLLDRVDLNKLPDPESSDEEWESKH

SEQ ID NO: 655 - DNA, 845 bp, Arabidopsis thaliana
  G1386
aattttatttccttctctcaaatcttcccaccaaaaattaactctttcgttcacactaagtcccttttaaaagaaaatatcccaattaatggaacgtgacgactgccggagatttcaggactcgccggcgcagacgacggagagaagagtgaaatataaaccaaagaagaaaagagccaaagatgatgatgatgagaaagttgtttcgaagcatccaaattttcgaggtgtcagaatgagacaatggggaaaatgggtgtccgaaatcagagagccaaaaaagaaatcaagaatctggctcggtactttctccacggcggagatggcggcgcgtgctcacgacgtggcagctttagccatcaaaggcggttctgcacatctcaacttcccggagctcgcttatcacctccctagaccagctagtgccgaccctaaagacatccaagctgccgccgccgcagctgcagccgctgtggccattgacatggatgtagagacgtcttcgccgtcgccatctcccacagttacggaaacgtcatctccggctatgatagcactctccgacgacgcgttctccgatcttcctgatctcttgctcaacgtgaaccataacatcgatggcttctgggactcttttccctatgaagaacccttcctctctcaaagttactagaaactcaaaactatgtcgtttttgtatgtatttttgtcatgtgaccattttttgacgtcgaaaatcacccggataatccaaattgtatgatttattaatggttgatgattttctttgtgtggaacaatgtgtatgatacgtaatcaaaagttcaaaaaaaaaataaaaaaaa

SEQ ID NO: 656 - protein, 194 aa, Arabidopsis thaliana
  G1386
MERDDCRRFQDSPAQTTERRVKYKPKKKRAKDDDDEKVVSKHPNFRGVRMRQWGKWVSEIREPKKKSRIWLGTFSTAEMAARAHDVAALAIKGGSAHLNFPELAYHLPRPASADPKDIQAAAAAAAAAVAIDMDVETSSPSPSPTVTETSSPAMIALSDDAFSDLPDLLLNVNHNIDGFWDSFPYEEPFLSQSY

SEQ ID NO: 657 - DNA, 894 bp, Arabidopsis thaliana
  G1412
atgggtgttagagagaaagatccgttagcccagttgagtttgccaccaggttttagattttatccgacagatgaagagcttcttgttcagtatctatgtcggaaagttgcaggctatcatttctctctccaggtcatcggagacatcgatctctacaagttcgatccttgggatttgccaagtaaggctttgtttggagagaaggaatggtatttctttagcccaagagatcggaaatatccgaacgggtcaagacccaatagagtagccgggtcgggttattggaaagcaacgggtactgacaaaattatcacggcggatggtcgtcgtgtcgggattaaaaaagctctggtcttttacgccggaaaagctcccaaaggcactaaaaccaactggattatgcacgagtatcgcttaatagaacattctcgtagccatggaagctccaagttggatgattgggtgttgtgtcgaatttacaagaaaacatctggatctcagagacaagctgttactcctgttcaagcttgtcgtgaagagcatagcacgaatgggtcgtcatcgtcttcttcatcacagcttgacgacgttcttgattcgttcccggagataaaagaccagtcttttaatcttcctcggatgaattcgctcaggacgattcttaacgggaactttgattgggctagcttggcaggtcttaatccaattccagagctagctccgaccaatggattaccgagttacggtggttacgatgcgtttcgagcggcggaaggtgaggcggagagtgggcatgtgaatcggcagcagaactcgagcgggttgactcagagtttcgggtacagctcgagtgggtttggtgtttcgggtcaaacattcgagtttaggcaatga

SEQ ID NO: 658 - protein, 297 aa, Arabidopsis thaliana
  G1412
MGVREKDPLAQLSLPPGFRFYPTDEELLVQYLCRKVAGYHFSLQVIGDIDLYKFDPWDLPSKALFGEKEWYFFSPRDRKYPNGSRPNRVAGSGYWKATGTDKIITADGRRVGIKKALVFYAGKAPKGTKTNWIMHEYRLIEHSRSHGSSKLDDWVLCRIYKKTSGSQRQAVTPVQACREEHSTNGSSSSSSSQLDDVLDSFPEIKDQSFNLPRMNSLRTILNGNFDWASLAGLNPIPELAPTNGLPSYGGYDAFRAAEGEAESGHVNRQQNSSGLTQSFGYSSSGFGVSGQTFEFRQ

SEQ ID NO: 659 - DNA, 1654 bp, Arabidopsis thaliana
  G1439
ctctgaagtgattatttagcactactttttctttgtctccttctgaatccattttttatggatcttggagttcgtgtttctggtcatgaaaccgtttcttctccgggtcaaactgaactcggatctggtttcagtaacaagcaagaaagatccggtttcgatggtgaagattgctggagaagttcaaagctctcacgaacatcaactgatggattctcttcttcccctgcctctgctaaaacgctgtcgtttcatcaaggcatccctttactgagatctaccactattaatgatcctcgtaaaggacaagaacacatgcttagcttctcttctgcttcaggcaaatcagatgtctcaccttatcttcagtactgtagaaactcaggatatggtttaggaggaatgatgaacacaagcaacatgcatggaaacttgttgacaggagtaaaaggacctttttcattgactcagtgggcagagctagagcaacaggcgttgatctataagtatatcacagccaatgtccctgttccatctagtttacttctctctctcaagaaatcttttttcccttatggttccttgcctcctaattcttttggatggggctcttttcatctgggcttttccggtggtaacatggatcccgagccagggagatgtcgccggacagatggaaagaaatggcggtgctcgagggacgctgttcccgatcaaaagtactgtgaacgacatattaacagaggccgccatcgttcaagaaagcctgtggaaggccaaaatggccacaatactaatgctgccgccgctgcttctgctgctgccgcttctaccgctgctgctgtgtccaaagcggcagcggggacttcagctgttgcgatgcgtggatcagataataacaatagccttgccgctgctgttggaacacaacatcataccaataatcaatctacagattctttggctaacagagttcaaaattctcgaggggcttcggtttttcctgccacgatgaacttacagtcgaaggaaactcatccgaaacaaagcaataatccctttgaattcggactcatctcttctgattcgttacttaatccgtcgcataaacaagcctcgtatgcaacctcttccaaaggctttggatcgtatcttgacttcggcaaccaagccaagcacgcggggaatcacaacaatgtcgattcttggcccgaagagctgaaatcggattggactcagctctcaatgtcaatccctatggctccatcttcccctgttcaagataaacttgcactctcacctttaaggttatcgcgtgagtttgaccccgcgatccacatgggattaggcgtcaacaccgagtttcttgaccccgggaaaaagacgaataactggataccaatctcctggggtaataacaactccatgggaggtccactcggcgaggtactaaacagcacgaccaatagtcccaagtttggttcctctccaacaggcgtcttgcaaaagtcgacatttggttctctttctaacagcagctcggcaagcagcaccatcattggcgataacaacaataagaacggtgatggaaaagatccgcttggcccgaccacgctgatgaatacttctgctactgctccttctctgtgaaact

SEQ ID NO: 660 - protein, 530 aa, Arabidopsis thaliana
  G1439
MDLGVRVSGHETVSSPGQTELGSGFSNKQERSGFDGEDCWRSSKLSRTSTDGFSSSPASAKTLSFHQGIPLLRSTTINDPRKGQEHMLSFSSASGKSDVSPYLQYCRNSGYGLGGMMNTSNMHGNLLTGVKGPFSLTQWAELEQQALIYKYITANVPVPSSLLLSLKKSFFPYGSLPPNSFGWGSFHLGFSGGNMDPEPGRCRRTDGKKWRCSRDAVPDQKYCERHINRGRHRSRKPVEGQNGHNTNAAAAASAAAASTAAAVSKAAAGTSAVAMRGSDNNNSLAAAVGTQHHTNNQSTDSLANRVQNSRGASVFPATMNLQSKETHPKQSNNPFEFGLISSDSLLNPSHKQASYATSSKGFGSYLDFGNQAKHAGNHNNVDSWPEELKSDWTQLSMSIPMAPSSPVQDKLALSPLRLSREFDPAIHMGLGVNTEFLDPGKKTNNWIPISWGNNNSMGGPLGEVLNSTTNSPKFGSSPTGVLQKSTFGSLSNSSSASSTIIGDNNNKNGDGKDPLGPTTLMNTSATAPSL

SEQ ID NO: 661 - DNA, 1131 bp, Arabidopsis thaliana
  G1482
cgtcgacaccaccatctctatctctctcttaatcgatcgatgaagatcaggtgcgacgtctgcgataaagaagaagcgtcggtgttttgcacggccgacgaagcatctctctgcggcggctgcgaccaccaagtccaccacgctaacaaactcgcctctaaacatctccgtttctctctcctttatccttcttcttccaacacctcctctcctctctgcgacatctgtcaggataaaaaagctctgttgttctgtcaacaagatagagctattttatgcaaagattgcgattcatcgatccacgctgcgaacgaacacacaaagaaacacgataggtttcttcttacaggggttaagctctctgcaacatcgtctgtttacaaacctacttcgaaatcttcttcttcttcttcaagcaaccaagatttctctgtccctggatcatcaatctctaatcctcctcctctcaagaaacctctctcagctcctcctcagagcaacaagatccaacccttttcgaagatcaacggcggtgatgcgtcggtgaatcagtggggatccacaagcacgatttctgagtatttgatggatacgttacctggttggcacgttgaggatttcctcgattcctctcttcctacttatggtttctctaagagtggtgatgatgatggagtgttaccatatatggaaccagaagatgacaacaacactaagagaaacaacaacaacaacaacaacaacaacaacaatacagtgtcacttccatctaagaatttagggatttgggtccctcagattccacaaactcttccttcttcatacccaaatcaatacttttctcaagacaacaacatacagtttgggatgtacaacaaagaaacatcaccagaagtagtgtcttttgctccaatacaaaacatgaaacaacaaggacagaacaacaagagatggtatgatgatggtggcttcactgtcccacagatcactcctcctcctctttcttctaataaaaagtttagatctttctggtaattttactatcttccctaaatgggggagttttttttttgtttgtttgtttctccttcatttctcccaactttgatctcagaattaggcgcggccgct

SEQ ID NO: 662 - protein, 331 aa, Arabidopsis thaliana
  G1482
MKIRCDVCDKEEASVFCTADEASLCGGCDHQVHHANKLASKHLRFSLLYPSSSNTSSPLCDICQDKKALLFCQQDRAILCKDCDSSIHAANEHTKKHDRFLLTGVKLSATSSVYKPTSKSSSSSSSNQDFSVPGSSISNPPPLKKPLSAPPQSNKIQPFSKINGGDASVNQWGSTSTISEYLMDTLPGWHVEDFLDSSLPTYGFSKSGDDDGVLPYMEPEDDNNTKRNNNNNNNNNNNTVSLPSKNLGIWVPQIPQTLPSSYPNQYFSQDNNIQFGMYNKETSPEVVSFAPIQNMKQQGQNNKRWYDDGGFTVPQITPPPLSSNKKFRSFW

SEQ ID NO: 663 - DNA, 1218 bp, Arabidopsis thaliana
  G1484
atgaaaagtttggctagtgcggttggagggaagacggcgagggcatgtgatagctgcgtgaagaggcgggcacgttggtattgcgcagctgatgatgcctttctttgccatgcttgtgacggttcggtccactcggcaaaccctcttgctcgtaggcacgagagagttcgcttgaaatcggctagcgccggaaagtatcgccatgcctcgccgcctcaccaagccacgtggcatcagggatttacacgtaaagctcggaccccacgtggaggcaagaagagccacacgatggtttttcatgatcttgtgccggagatgagcacggaggatcaagcggagagttacgaggtggaagagcagctcatatttgaggtgccggtgatgaactcgatggttgaggagcaatgctttaaccaatccctggagaaacagaatgagtttccaatgatgcccttaagtttcaagagtagtgacgaagaagatgacgacaacgctgagagttgtctgaatggtttgttcccaaccgacatggaactagctcagttcacagctgacgtggagactctactcggtggaggggatcgagagtttcattccatagaagaactagggttaggtgagatgttaaagatcgaaaaagaggaggtggaggaagagggagttgtgacaagagaagtgcatgatcaagatgaaggtgatgagacatccccatttgaaataagctttgactacgagtacacacacaagaccacattcgatgaaggagaagaagatgagaaagaagacgtgatgaagaatgtgatggagatgggagtgaatgagatgagtggtgggattaaagaagagaagaaggagaaggctcttatgcttagattggactatgaatcagtcatttccacttggggaggccaagggatcccatggaccgcccgggtgccatctgaaatagacctcgacatggtttgtttcccaacccataccatgggtgaaagtggagcagaggctcatcatcacaaccacttccgcggcctagggttacacctaggagatgctggggatggaggaagagaggctagggtttcaagataccgagagaaaaggaggacaaggttgttctccaagaagataaggtacgaggtacgtaaattgaatgcagagaaaaggcctcgcatgaaaggaaggttcgtcaagagatcttcaattggtgttgctcactaa

SEQ ID NO: 664 - protein, 405 aa, Arabidopsis thaliana
  G1484
MKSLASAVGGKTARACDSCVKRRARWYCAADDAFLCHACDGSVHSANPLARRHERVRLKSASAGKYRHASPPHQATWHQGFTRKARTPRGGKKSHTMVFHDLVPEMSTEDQAESYEVEEQLIFEVPVMNSMVEEQCFNQSLEKQNEFPMMPLSFKSSDEEDDDNAESCLNGLFPTDMELAQFTADVETLLGGGDREFHSIEELGLGEMLKIEKEEVEEEGVVTREVHDQDEGDETSPFEISFDYEYTHKTTFDEGEEDEKEDVMKNVMEMGVNEMSGGIKEEKKEKALMLRLDYESVISTWGGQGIPWTARVPSEIDLDMVCFPTHTMGESGAEAHHHNHFRGLGLHLGDAGDGGREARVSRYREKRRTRLFSKKIRYEVRKLNAEKRPRMKGRFVKRSSIGVAH

SEQ ID NO: 665 - DNA, 2232 bp, Arabidopsis thaliana
  G1588
atgtaccatccaaacatgtttgagagccatcatatgttcgatatgaccccaaagagtacctctgataacgacttgggaatcaccggtagccgagaagatgactttgagaccaagtcaggtaccgaagtcactactgagaatccttctggtgaagagcttcaagatcctagccaacgtcccaacaaaaagaagcgttaccatcgccacacgcaacgccaaattcaagagctcgaatcattctttaaggaatgtcctcatccagatgataagcaacgaaaagagttgagccgtgatctcaatttagagcctcttcaagttaagttttggttccaaaacaaacgcacacagatgaaggcacaaagtgagaggcatgagaaccagattctaaagtcagacaatgacaagctcagagcagagaacaatagatacaaagaagctctaagcaatgctacatgccctaactgtggcggtccagctgctattggagaaatgtcttttgacgaacaacatctcaggatcgaaaatgctcggctccgcgaagagattgataggatctctgctattgctgcgaaatacgttgggaagccgttaggatcgtctttcgctccactagcgatccacgcgccttctcgttcgcttgatcttgaagttggaaactttgggaaccagacaggctttgtaggagaaatgtatggaacaggggacattttgaggtcagtttcgattccttctgagactgataagcctataatcgtggagctagcggttgcagctatggaggaactcgtgagaatggctcaaactggagatcctttatggctttcaaccgataattcagtcgagattctcaacgaagaagagtatttcagaacgtttccgagaggaattggaccaaagccattaggattaagatcagaggcgtcaagacaatctgcagttgttataatgaatcacatcaatctcgttgagattctcatggatgtgaatcaatggtcttgtgttttctctgggattgtgtcaagagccttgacacttgaagttctttcaactggagttgctgggaactacaacggtgctttacaagtgatgacagctgagtttcaagttccatcacccctagtcccaacgcgtgagaactactttgtgagatactgcaaacaacacagtgacggctcttgggctgtggttgatgtctctttggacagccttagaccaagtactccaatcttaagaactagaagaaggccttcaggttgtctgattcaagaattgcctaatggttattctaaggttacatggatagagcatatggaggtagatgatagatcagttcacaacatgtataaaccgttggttcagtccggtttagctttcggtgcgaaacgttgggtggctacactcgaacgacaatgcgagcggcttgctagctccatggccagcaacattcctggtgatctttccgtgataacgagtcctgaaggaaggaagagtatgttgaagctagctgagagaatggttatgagtttctgcagtggtgttggcgcgtcgactgcacacgcttggacaacaatgtcgacaacaggatccgatgatgttcgggtcatgacccgcaagagtatggatgatccaggaagacctccgggtattgttcttagtgcagctacttcattctggatcccagttgctcccaaacgtgtttttgatttcctccgtgacgaaaattcaagaaaagagtgggatattctgtcaaatggaggtatggttcaggaaatggctcatatagccaatggtcatgaacctggaaactgtgtctccttgctccgagtcaatagtggaaactcgagccagagcaacatgttgattctacaagagagctgtacagatgcatcaggatcgtatgtgatttacgcgccagtggatatagtggcgatgaatgtggttctaagcggtggagatcctgattacgtggcgttgttgccgtctggttttgctattttaccggatggttcggttggaggaggagatgggaatcagcatcaggaaatggtttctactacttcttctgggagttgtggtggttcgcttttaaccgttgcgtttcagattcttgttgactctgttcctacagctaaactctcacttggctcggtggctacggttaatagtctgatcaaatgtacggtggagaggattaaagctgctgtttcttgtgatgttggaggaggagcgtag

SEQ ID NO: 666 - protein, 743 aa, Arabidopsis thaliana
  G1588
MYHPNMFESHHMFDMTPKSTSDNDLGITGSREDDFETKSGTEVTTENPSGEELQDPSQRPNKKKRYHRHTQRQIQELESFFKECPHPDDKQRKELSRDLNLEPLQVKFWFQNKRTQMKAQSERHENQILKSDNDKLRAENNRYKEALSNATCPNCGGPAAIGEMSFDEQHLRIENARLREEIDRISAIAAKYVGKPLGSSFAPLAIHAPSRSLDLEVGNFGNQTGFVGEMYGTGDILRSVSIPSETDKPIIVELAVAAMEELVRMAQTGDPLWLSTDNSVEILNEEEYFRTFPRGIGPKPLGLRSEASRQSAVVIMNHINLVEILMDVNQWSCVFSGIVSRALTLEVLSTGVAGNYNGALQVMTAEFQVPSPLVPTRENYFVRYCKQHSDGSWAVVDVSLDSLRPSTPILRTRRRPSGCLIQELPNGYSKVTWIEHMEVDDRSVHNMYKPLVQSGLAFGAKRWVATLERQCERLASSMASNIPGDLSVITSPEGRKSMLKLAERMVMSFCSGVGASTAHAWTTMSTTGSDDVRVMTRKSMDDPGRPPGIVLSAATSFWIPVAPKRVFDFLRDENSRKEWDILSNGGMVQEMAHIANGHEPGNCVSLLRVNSGNSSQSNMLILQESCTDASGSYVIYAPVDIVAMNVVLSGGDPDYVALLPSGFAILPDGSVGGGDGNQHQEMVSTTSSGSCGGSLLTVAFQILVDSVPTAKLSLGSVATVNSLIKCTVERIKAAVSCDVGGGA

SEQ ID NO: 667 - DNA, 933 bp, Arabidopsis thaliana
  G1752
aaaaaaaaaaaaaaaaaaaaacttatggaatattcccaatcttccatgtattcatctccaagttcttggagctcatcacaagaatcactcttatggaacgagagctgtttcttggatcaatcatctgaacctcaagccttcttttgccctaattatgattactccgatgactttttctcatttgagtcaccggagatgatgattaaggaagaaattcaaaacggcgacgtttctaactccgaagaagaagaaaaggttggaattgatgaagaaagatcatacagaggagtgaggaaaaggccgtgggggaaatttgcagcggagataagagattcaacgaggaatggaattagggtttggctcgggacatttgacaaagccgaggaagccgctcttgcttatgatcaagcggctttcgccacaaaaggatctcttgcaacacttaatttcccggtggaagtggttagagagtcgctaaagaaaatggagaatgtgaatcttcatgatggaggatctccggttatggccttgaagagaaaacattctcttcgaaaccggcctagagggaaaaagcgatcctcttcttcttcttcttcttcttctaattcttcttcttgctcttcttcttcgtctacttcttcaacatcaagaagtagtagtaagcagagtgttgtgaagcaagaaagtggtacacttgtggtttttgaagatttaggtgctgagtatttagaacaacttcttatgagctcatgttgatcttgtaattgatttcagcaaaagccactattaaactttaattttgtgataattaatcttgaaatttgttttgttcattctgcaatttctttggttctcttattttttgtttgttgtatccaaatgaaattattggaagagatggtgatgttaaagtgtatatatataaaaaaaaaa

SEQ ID NO: 668 - protein, 243 aa, Arabidopsis thaliana
  G1752
MEYSQSSMYSSPSSWSSSQESLLWNESCFLDQSSEPQAFFCPNYDYSDDFFSFESPEMMIKEEIQNGDVSNSEEEEKVGIDEERSYRGVRKRPWGKFAAEIRDSTRNGIRVWLGTFDKAEEAALAYDQAAFATKGSLATLNFPVEVVRESLKKMENVNLHDGGSPVMALKRKHSLRNRPRGKKRSSSSSSSSSNSSSCSSSSSTSSTSRSSSKQSVVKQESGTLVVFEDLGAEYLEQLLMSSC

SEQ ID NO: 669 - DNA, 668 bp, Arabidopsis thaliana
  G1836
ataacaagcctagaacactagaaacttcaaaaaagaaaaaaatcttatggagaacaacaacggcaacaaccagctgccaccgaaaggtaacgagcaactgaagagtttctggtcaaaagagatggaaggtaacttagatttcaaaaatcacgaccttcctataactcgtatcaagaagattatgaagtatgatccggatgtgactatgatagctagtgaggctccaatcctcctctcgaaagcatgtgagatgtttatcatggatctcacgatgcgttcgtggctccatgctcaggaaagcaaacgagtcacgctacagaaatctaatgtcgatgccgcagtggctcaaactgttatctttgatttcttgcttgatgatgacattgaggtaaagagagagtctgttgccgccgctgctgatcctgtggccatgccacctattgacgatggagagctgcctccaggaatggtaattggaactcctgtttgttgtagtcttggaatccaccaaccacaaccacaaatgcaggcatggcctggagcttggacctcggtgtctggtgaggaggaagaagcgcgtgggaaaaaaggaggtgacgacggaaactaataagtggaatacgttttagggtattttcaagggaatatgtagtaaatagtcatggatc

SEQ ID NO: 670 - protein, 187 aa, Arabidopsis thaliana
  G1836
MENNNGNNQLPPKGNEQLKSFWSKEMEGNLDFKNHDLPITRIKKIMKYDPDVTMIASEAPILLSKACEMFIMDLTMRSWLHAQESKRVTLQKSNVDAAVAQTVIFDFLLDDDIEVKRESVAAAADPVAMPPIDDGELPPGMVIGTPVCCSLGIHQPQPQMQAWPGAWTSVSGEEEEARGKKGGDDGN

SEQ ID NO: 671 - DNA, 1554 bp, Arabidopsis thaliana
  G1942
cactccaaatggctcttgtgctctcagaacacacacagatataataaactcttaacgaagaagaagactttttcttttcttgagcaagctctgagaaactcacagagagggacagagagagaaatatttcattcgctactctctttaataccgccattgatgcaacctccttcgcgttaactgtcaaaatactccccaactgacaaaaattaaattcctttttttctctctcgattttaaaagctctaaaaggaacgagttgatcaagtcggtcggttctggttatcactgaatttcattcaactcggtttattccggtttaagtgtgattttcccggctaatggatctgacccaaggtttcagagctagatccggcgttgttgggccggtggccggactagaatctctcaatttcagcgacgaatttcggcacttagtgacgacgatgcctccggagactactggcggctccttcacggctttactcgagatgcctgtgactcaggccatggagcttctccatttcccagattcatcgtcttctcaggccagaaccgttaccagtggtgatatttctcctaccactcttcaccctttcggggctttgacttttccttctaactcgcttctcttggaccgcgccgctcgtttctcggtgattgctacagagcaaaacggtaatttttccggcgagactgctaactctttaccttctaatcccggcgcgaatctggacagagtcaaagccgagcctgctgagaccgattcaatggtggagaatcagaaccagagctactcttctggaaaaaggaaagaacgcgagaagaaggtcaaaagctcgacgaagaagaacaagagctccgtggagtcagacaagttgccatatgttcatgtcagagctcgtcgtggtcaagctactgataaccatagcttagcagagagagcaagaagggagaagataaacgcacgaatgaagctgctacaggaactggtcccaggctgtgataagattcagggcactgcattggttctggatgaaatcattaaccatgtgcaaactttacagcgtcaagtggagatgctatctatgagacttgctgcagtaaaccccagaatcgacttcaatctagacagcatactggcttcagagaacggctctcttatggatggtagcttcaatgcagagtcttatcatcagctgcaacaatggcctttcgacggctaccaccagccggaatggggaagagaagaagatcatcatcaagccaatttctcaatgggttcagctactttacacccaaatcaggtgaaaatggagctctaagttggaaacagtttgacatgcttatgtgtatatataagagttatatatatctactaaagtttcgattgttgaattagaggtagaaaatggttatgattgtttcaggtctttgttcatggcctttctatatttactagattcctcaatgtagaattcagaatgtctaaattgcgtttcccttgagagaagtatatgaagatttgatatgttactgaacaaaaaaaaaaaa

SEQ ID NO: 672 - protein, 327 aa, Arabidopsis thaliana
  G1942
MDLTQGFRARSGVVGPVAGLESLNFSDEFRHLVTTMPPETTGGSFTALLEMPVTQAMELLHFPDSSSSQARTVTSGDISPTTLHPFGALTFPSNSLLLDRAARFSVIATEQNGNFSGETANSLPSNPGANLDRVKAEPAETDSMVENQNQSYSSGKRKEREKKVKSSTKKNKSSVESDKLPYVHVRARRGQATDNHSLAERARREKINARMKLLQELVPGCDKIQGTALVLDEIINHVQTLQRQVEMLSMRLAAVNPRIDFNLDSILASENGSLMDGSFNAESYHQLQQWPFDGYHQPEWGREEDHHQANFSMGSATLHPNQVKMEL

SEQ ID NO: 673 - DNA, 1153 bp, Arabidopsis thaliana
  G2065
aaccacacaaaacaaaacaaaaaaacatattgatggggatgaagaaggtaaagctatctttgatagctaatgaaagatcaaggaaaacatccttcatgaagaggaaaaacgggatattcaagaaactccacgagttgtcaactctatgtggtgtccaagcttgtgctctcatctatagtccattcataccggttccagagtcatggccgtcaagggaaggtgctaaaaaggtagcttcaaagtttctggagatgccgcggacagcccgaaccaggaagatgatggatcaagaaacccatcttatggagaggattaccaaagcaaaagagcaactaaagaatttggctgctgagaaccgagaattacaggttagacgatttatgtttgattgtgttgaaggcaaaatgtcccagtatcgttatgatgcaaaagaccttcaagatttgctatcttgtatgaatctatatctcgatcagcttaacggaaggatcgagtccattaaagaaaacggtgagtcgttgttgtcttccgtctctccttttcctactagaattggtgttgacgaaattggtgatgagtcgttttccgactctcctattcattctacaactagggttgtagatactcctaatgctaccaatcctcatgttcttgcgggcgatatgactccttttcttgatgcggacgcaaatgcggtaactgctcccagtcgattttctgatcatattcaatatgaaaatatgaatatgagtcaaaatctgcatgaaccgtttcaacaccttgttcctactaacgtttgtgatttttatcaaaatcagaatatgaatcaggttcaataccaggctcctaataatctgtttaatcagattcaacgagaattctacaacataaatttgaatctgaatttgaatctgaattcaaatcagtatctgaatcaacaacaatcattcatgaatccgatggtggaacaacatatgaatcatgttggagggcgtgaaagcattcctttcgtggacagaaactactacaactacaatcaactaccagccgttgatcttgcttccaccagttacatgccttcaaccaccgatgtttatgatccttacatcaacaacaatctctaatcacaaaagacggagattttctagtttaa

SEQ ID NO: 674 - protein, 363 aa, Arabidopsis thaliana
  G2065
MGMKKVKLSLIANERSRKTSFMKRKNGIFKKLHELSTLCGVQACALIYSPFIPVPESWPSREGAKKVASKFLEMPRTARTRKMMDQETHLMERITKAKEQLKNLAAENRELQVRRFMFDCVEGKMSQYRYDAKDLQDLLSCMNLYLDQLNGRIESIKENGESLLSSVSPFPTRIGVDEIGDESFSDSPIHSTTRVVDTPNATNPHVLAGDMTPFLDADANAVTAPSRFSDHIQYENMNMSQNLHEPFQHLVPTNVCDFYQNQNMNQVQYQAPNNLFNQIQREFYNINLNLNLNLNSNQYLNQQQSFMNPMVEQHMNHVGGRESIPFVDRNYYNYNQLPAVDLASTSYMPSTTDVYDPYINNNL

SEQ ID NO: 675 - DNA, 1126 bp, Arabidopsis thaliana
  G2106
cctcttcttttatgttcatcgccgtcgaagtttctccggtaatggaagacatcacacggcagagcaaaaaaacttcggttgagaatgaaaccggcgatgatcagtcagcaacatcagtagtccttaaagctaaacgcaaacgccgatcgcaaccacgagacgctccaccccaacgtagctccgtccatagaggcgtcacaaggcatcgatggactggaaggtacgaagcacatttgtgggataagaatagttggaacgaaactcagaccaagaaaggaagacaagtatatttaggggcatatgacgaggaagatgcagcagcacgtgcctacgacttagcagcattgaaatattggggacgagacaccatcttgaacttccctgtaaattttctcggaatcctattgtgtaattatgaagaagacatcaaagaaatggaaagccagtcaaaggaagagtatattggatctttgagaagaaaaagtagtgggttttcacgaggtgtatcaaaatacagaggcgttgcaaagcatcaccacaatgggagatgggaagctcgaatcggaagagtgtttggcaataaatatttataccttggaacttacgcgacgcaagaagaagcagctatagcgtacgatatcgcagctatcgagtaccgtggactcaacgccgttactaacttcgacatcagccgttatctgaaactcccggtgccggagaaccctatcgataccgcgaataatctcctcgagagtccgcattctgatcttagcccatttataaaacctaaccacgagtctgacttatcacagagtcaatcttcgtcagaggacaacgatgatcggaaaacaaagctcttgaagtcgtcacctttagtggcagaggaggtaatcggaccatcgacgccacctgagattgctccgcctcgtcggagcttcccggaagatatccagacgtatttcgggtgtcaaaactccggcaagttaacggcggaggaagatgatgttatcttcggtgatttagattctttccttacgcctgatttctacagcgagttaaatgattgctaaagtgttgttcttctgataagttttgttttttagttgttcagaatctcggttgtgaa

SEQ ID NO: 676 - protein, 352 aa, Arabidopsis thaliana
  G2106
MFIAVEVSPVMEDITRQSKKTSVENETGDDQSATSVVLKAKRKRRSQPRDAPPQRSSVHRGVTRHRWTGRYEAHLWDKNSWNETQTKKGRQVYLGAYDEEDAAARAYDLAALKYWGRDTILNFPVNFLGILLCNYEEDIKEMESQSKEEYIGSLRRKSSGFSRGVSKYRGVAKHHHNGRWEARIGRVFGNKYLYLGTYATQEEAAIAYDIAAIEYRGLNAVTNFDISRYLKLPVPENPIDTANNLLESPHSDLSPFIKPNHESDLSQSQSSSEDNDDRKTKLLKSSPLVAEEVIGPSTPPEIAPPRRSFPEDIQTYFGCQNSGKLTAEEDDVIFGDLDSFLTPDFYSELNDC

SEQ ID NO: 677 - DNA, 845 bp, Arabidopsis thaliana
  G2107
accacaaaacagagcaacacacaacacaaagcttcatttcaattctgtttcgagaaccctttgagaaccagatcggagatggaaaacgacgatatcaccgtggcggagatgaagccaaagaagcgtgctggacggaggattttcaaggagacacgtcacccaatctacagaggcgtgcggcgtagggacggcgacaaatgggtatgcgaagtccgtgaaccgattcatcagcgtcgagtctggctcggaacttatccgacggcagatatggccgcacgtgctcacgacgtggcggttcttgctctgcgcgggagatccgcgtgtttgaatttctccgattctgcttggaggttgccggtgccggcatccactgatccggacacgatcaggcgcacggcggccgaagcagcggagatgttcaggccgccggagtttagtacaggaattacggttttaccctcagccagtgagtttgacacgtcggatgaaggagtcgctggaatgatgatgaggctcgcggaggagccgttgatgtcgccgccaagatcgtacattgatatgaatacgagtgtgtacgtggacgaagaaatgtgttacgaagatttgtcactttggagttactaaaatacgtatgtgttaaaaaaccaaagatcgtatgtgtatgtatgcataataaatgggcttaatgatgggcatagatatgataggtccagcctatatgttaaatgtgttttattttttggtttatctagtttcctaggtatttaccaaattgtattagtataagttttattaagaaataatcaaaaatgttgttgccaaaaaaaaaaaaaaaaaaaaaaaaa

SEQ ID NO: 678 - protein, 181 aa, Arabidopsis thaliana
  G2107
MENDDITVAEMKPKKRAGRRIFKETRHPIYRGVRRRDGDKWVCEVREPIHQRRVWLGTYPTADMAARAHDVAVLALRGRSACLNFSDSAWRLPVPASTDPDTIRRTAAEAAEMFRPPEFSTGITVLPSASEFDTSDEGVAGMMMRLAEEPLMSPPRSYIDMNTSVYVDEEMCYEDLSLWSY

SEQ ID NO: 679 - DNA, 929 bp, Arabidopsis thaliana
  G2148
gtctctaatataagcttgaacgttgctatatataaatgtaaaggcgaacgcataagaaaagaaaaatggagaatgaagcttttgtagatggtgaattggagtctcttttggggatgttcaactttgatcaatgttcatctaacgaatcgagcttttgcaatgctccaaatgagactgatgttttctcttctgatgatttcttcccatttggtacaattctgcaaagtaactatgcggccgttcttgatggttccaaccaccaaacgaaccgaaatgtcgactcaagacaagatctgttgaaaccaaggaagaagcaaaagttaagctcggaaagcaatttggttaccgagcctaagactgcttggagagatggtcaaagcctaagcagttataatagttcagatgatgaaaaggctttaggtttagtgtctaatacatcaaaaagcctaaaacgcaaagcgaaagccaacagagggatagcttccgatcctcagagcctatacgctaggaaacgaagagaaaggataaacgataggctaaagacattgcagagcctagttcctaatgggacaaaggtcgatataagcacaatgctggaagatgctgtccattacgtgaagttcctgcagcttcaaatcaagctcttgagttcagaagatctatggatgtatgcacctcttgctcacaatggtctgaatatgggactacatcacaatcttttgtctcggcttatttaagacaaaatcattggaataacataacttacagtacttgttttttttctcgttctatattcatgattatggttattttttgtttgagttgttcaatttttctgtctattgcgttctatgaacttgacactctttttgtaattattatatgctaaagacaatttggactaacagcattttaataaaaaaaaaaaa

SEQ ID NO: 680 - protein, 223 aa, Arabidopsis thaliana
  G2148
MENEAFVDGELESLLGMFNFDQCSSNESSFCNAPNETDVFSSDDFFPFGTILQSNYAAVLDGSNHQTNRNVDSRQDLLKPRKKQKLSSESNLVTEPKTAWRDGQSLSSYNSSDDEKALGLVSNTSKSLKRKAKANRGIASDPQSLYARKRRERINDRLKTLQSLVPNGTKVDISTMLEDAVHYVKFLQLQIKLLSSEDLWMYAPLAHNGLNMGLHHNLLSRLI

SEQ ID NO: 681 - DNA, 1440 bp, Arabidopsis thaliana
  G2180
atggctcctgtctcgttacctccaggtttccgattccatccaacagacgaggaactaattacttactatctaaaaagaaagatcaacggtctagaaatcgaacttgaagttatcgctgaagttgatctttacaagtgtgagccatgggacttaccagggaagtccttgcttccgagcaaagaccaagaatggtacttcttcagcccacgagaccggaagtatcccaacggctcaaggacaaaccgggcaactaaaggcggttattggaaggctacaggtaaagaccgccgagttagttggagagaccgagccataggaaccaagaagacattggtttactaccgtgggcgcgcgccacatggcataagaactggttgggtcatgcacgaatatcgacttgatgaaacagaatgtgagccttctgcatacggcatgcaggacgcatatgcactttgtcgtgtgttcaaaaagattgttattgaagctaagccaagagatcaacatcggtcatatgtccacgcgatgtcgaatgtgagtggtaattgctcatcgagttttgacacttgttcggatctcgaaatcagttcaactactcatcaagttcaaaacacattccaaccgcgatttggcaacgagcgatttaactccaacgcaatcagcaacgaggattggtcacaatactacggttcttcttatagaccgttccctactccatataaggttaacacagagatcgaatgttcaatgttacaacacaatatatatctaccaccgttgcgtgtagagaactctgcgtttagtgattccgatttcttcacgagtatgactcacaacaacgaccatggcgttttcgatgactttacttttgctgcaagtaactccaaccacaataatagcgttggtgatcaagtgatccacgttggcaattatgatgaacaattaataacatctaaccgtcatatgaaccagactggttatataaaagagcagaagatcagatcgagtttggataatactgacgaagatccaggatttcatggtaacaataccaatgacaacatagatatcgatgattttctctcgtttgatatatataacgaggacaacgtgaatcaaatagaagataatgaagacgtgaatacaaatgaaacccttgattcatcgggattcgaggtggttgaagaagaaactagatttaacaaccaaatgctcatctcgacatatcaaacgacaaagattctatatcaccaagtcgtaccttgtcacacgttgaaagttcacgtcaatcctattagtcacaatgtggaagagagaacattgttcattgaagaggacaaagattcttggttacaaagagctgagaagatcacgaagacaaaactaacactttttagtttaatggctcagcaatactacaaatgtcttgctatttttttctga

SEQ ID NO: 682 - protein, 479 aa, Arabidopsis thaliana
  G2180
MAPVSLPPGFRFHPTDEELITYYLKRKINGLEIELEVIAEVDLYKCEPWDLPGKSLLPSKDQEWYFFSPRDRKYPNGSRTNRATKGGYWKATGKDRRVSWRDRAIGTKKTLVYYRGRAPHGIRTGWVMHEYRLDETECEPSAYGMQDAYALCRVFKKIVIEAKPRDQHRSYVHAMSNVSGNCSSSFDTCSDLEISSTTHQVQNTFQPRFGNERFNSNAISNEDWSQYYGSSYRPFPTPYKVNTEIECSMLQHNIYLPPLRVENSAFSDSDFFTSMTHNNDHGVFDDFTFAASNSNHNNSVGDQVIHVGNYDEQLITSNRHMNQTGYIKEQKIRSSLDNTDEDPGFHGNNTNDNIDIDDFLSFDIYNEDNVNQIEDNEDVNTNETLDSSGFEVVEEETRFNNQMLISTYQTTKILYHQVVPCHTLKVHVNPISHNVEERTLFIEEDKDSWLQRAEKITKTKLTLFSLMAQQYYKCLAIFF

SEQ ID NO: 683 - DNA, 841 bp, Arabidopsis thaliana
  G2513
tttcaacagtaatttaagttaaccggagtctctttttgttttccggcgaatttttggtactttgagttatgaataatgatgatattattctggcggagatgaggcctaagaagcgtgcgggaaggagagtgtttaaggagacacgtcacccagtttacagaggcataaggcggaggaacggtgacaaatgggtctgcgaagtcagagaaccgacgcaccaacgccgcatttggctcgggacttatcccacagcagatatggcagcgcgtgcacacgacgtggcggttttagctctgcgtgggagatccgcatgtttgaatttcgccgactccgcttggcggcttccggtgccggaatccaatgatccggatgtgataagaagagttgcggcggaagctgcggagatgtttaggccggtggatttagaaagtggaattacggttttgccttgtgcgggagatgatgtggatttgggttttggttcgggttccggctctggttcgggatcggaggagaggaattcttcttcgtatggatttggagactacgaagaagtctcaacgacgatgatgagactcgcggaggggccactaatgtcgccgccgcgatcgtatatggaagacatgactcctactaatgtttacacggaagaagagatgtgttatgaagatatgtcattgtggagttacagatattaagtgggactcacatatctactatacataatatttagcttttatgtaagaggtatttatgtgagttttaagattgtagatgtgtcccaggcgttagaagtttccttgatggtatggaatctttgtacctataaaattataaaatt

SEQ ID NO: 684 - protein, 209 aa, Arabidopsis thaliana
  G2513
MNNDDIILAEMRPKKRAGRRVFKETRHPVYRGIRRRNGDKWVCEVREPTHQRRIWLGTYPTADMAARAHDVAVLALRGRSACLNFADSAWRLPVPESNDPDVIRRVAAEAAEMFRPVDLESGITVLPCAGDDVDLGFGSGSGSGSGSEERNSSSYGFGDYEEVSTTMMRLAEGPLMSPPRSYMEDMTPTNVYTEEEMCYEDMSLWSYRY

SEQ ID NO: 685 - DNA, 876 bp, Arabidopsis thaliana
  G2545
atgcaagaagcggcactaggtatgatgggagccaccgtaggcggagacggagacaccgcggtcgtggcggagcagaatagacagttgaaaggtgagatagcgacacatccgatgtatgagcaattattagccgcacacgtggcgtgtttaagagtagctactccaatagatcaacttccgatcattgaagctcagctttctcaatctcatcatcttctccgttcttacgcttccacggccgttggataccatcatgatcgtcacgagctcgataatttcttggcacaatatgtaatggtgttgtgtagcttcaaagaacagctgcaacagcacgtgagggttcatgccgtcgaagctgttatggcttgccgtgaaattgagaacaaccttcattctcttacaggagcaactttaggagaagggtcgggtgcgactatgtcggaggatgaggatgatcttccgatggatttctcgtcagataattccggcgttgattttagcggcggccacgatatgacgggatttggtccgttgctaccgactgaatcggaaagatcccttatggaaagagtcagacaagaactcaaactagaactcaaacagggttttaaatcgagaatcgaagatgtaagagaagagataatgaggaagagaagggctgggaaattgccaggagacacaactactgtcttgaaaaattggtggcaacaacattgcaaatggccttaccctacggaagatgacaaggcaaaattggtggaggagacaggattgcagttgaagcaaatcaacaattggttcattaaccaacgcaagaggaattggcacaacaactctcactccctcacttccttgaagtccaagcgcaaacactaa

SEQ ID NO: 686 - protein, 291 aa, Arabidopsis thaliana
  G2545
MQEAALGMMGATVGGDGDTAVVAEQNRQLKGEIATHPMYEQLLAAHVACLRVATPIDQLPIIEAQLSQSHHLLRSYASTAVGYHHDRHELDNFLAQYVMVLCSFKEQLQQHVRVHAVEAVMACREIENNLHSLTGATLGEGSGATMSEDEDDLPMDFSSDNSGVDFSGGHDMTGFGPLLPTESERSLMERVRQELKLELKQGFKSRIEDVREEIMRKRRAGKLPGDTTTVLKNWWQQHCKWPYPTEDDKAKLVEETGLQLKQINNWFINQRKRNWHNNSHSLTSLKSKRKH

SEQ ID NO: 687 - DNA, 719 bp, Arabidopsis thaliana
  G2576
caatcgcgtctttgtttggtttaatcgtgatggaagggtcgtcttcttcgatgcagtcaaagtacaaaggagtgaggaagaggaaatggggaaaatgggtttcagagatcagacttcccaacagcagagaacgtatttggttgggctcttacgatactcctgagaaggcggcgcgtgctttcgacgcggctctttattgtctccgtggcaacaacgcaaagttcaatttccctgataatcctccggtgatctccggcggacgtaacttgtcgcgatctgagataagagaagctgctgcgaggttcgctaattcggcggaggatgattcaagtggcggagcaggatacgagatacggcaagaatctgcttcaacatcgatggacgttgattcggagtttttgagtatgcttccgacggttggttcgggtaacttcgcttcggagtttgggttattccctgggtttgatgatttctccgatgaatactccggtgatcgtttcagagagcagctttcgcctacacaagattattatcagcttggagaagagacttacgccgatggttccatgtttctttggaatttttgaattccattattcacaatctgaaaattttgacttgggttttttatttttttttgtagttctttacccaatttttttttgatcattgggataaagagttattcattcactatttttttcccacgtgttagattt

SEQ ID NO: 688 - protein, 185 aa, Arabidopsis thaliana
  G2576
MEGSSSSMQSKYKGVRKRKWGKWVSEIRLPNSRERIWLGSYDTPEKAARAFDAALYCLRGNNAKFNFPDNPPVISGGRNLSRSEIREAAARFANSAEDDSSGGAGYEIRQESASTSMDVDSEFLSMLPTVGSGNFASEFGLFPGFDDFSDEYSGDRFREQLSPTQDYYQLGEETYADGSMFLWNF

SEQ ID NO: 689 - DNA, 1871 bp, Arabidopsis thaliana
  G3041
ttatttcgaaatcattgttttgctctttcttttgattcgaattcgacagaacagctcttttaagttattcataaaccttgtgtttgagttttggtccatcgagtatatgggtcgtggctcagtaacatcgctcgctcctgggtttcgttttcatcccacagacgaagaactcgttcgttactatctgaaacgaaagatctgcaataaaccttttaagttcgatgctatctctgttaccgatgtatacaaatctgagccttgggatctcccagacaagtcgaggctgaaaagtagagacttggagtggtacttcttcagtatgcttgataagaagtatagaaatggatcaaagacgaatcgtgcgactgagatgggatattggaagactacagggaaagatcgagagattcttaatggttcaaaagtcgttgggatgaagaagactcttgtttatcacaaaggtcgagctcctcgtggcgaaagaaccaattgggttatgcatgagtatcggttggttgatcaagaccttgataaaactggtgttcaccaagatgcgtttgtgctttgtaggatttttcagaagagtggctccggacctaaaaatggagagcagtacggtgctccgtttgttgaggaggagtgggaggaggaggatgatatgacatttgtacctgaccaagaagatcttggaagtgaagatcatgtttatgtccatatggatgacattgatcagaagtctgaaaactttgtggtctatgatgccattcctattccgttaaactttattcacggggagtcgagcaataatgttgaaacaaactactcagactccataaactatatacaacaaacaggaaactatatggactctggtggctactttgagcaaccagcagaatcttatgagaaagatcagaagcctatcatccgtgaccgtgatggtagccttcaaaatgaaggaattggatgtggggtccaggacaagcactcggaaactttgcaatcttctgacaacatctttgggactgatacatcatgctacaatgattttccagttgagagcaactatttgattggtgaggcgtttctggatccgaacagtaatcttctggagaatgatggtctgtacctggaaacaaatgatctcagtagtactcagcaagatggtttcgactttgaagattatcttaccttctttgatgaaacttttgatccttcgcaactgatgggaaatgaagatgtttttttcgatcaagaagagctctttcaagaggttgagactaaggaactagagaaagaggagacttcaagaagcaaacatgtggtggaagaaaaggaaaaggatgaagcatcttgttcaaaacaagttgatgcagatgcaacagagtttgagccagattacaagtacccgttactaaagaaggcaagccacatgttgggtgctattcctgctccgcttgcaaatgcttctgagttccctacaaaggatgcagctatccggttacacgcagcacaatcatcaggttcagttcatgtaaccgcaggtatgatcacgatatcagacagcaacatgggctggtcatacggcaaaaacgagaaccttgacttgatcctttctttggggttggtccaagggaataccgcccccgaaaaatcagggaatagttcagcatgggcaatgttaatattcatgtgtttctgggttcttctactctcagttagtttcaaagtgagcattttggtctcttccaggtgataggtaaccctttcttgttcaaacaagacttttgtgtttgtacattgatatagatgaacttgcagtgttcaatgttttattctctaataatattgaataaaccccatattctatc

SEQ ID NO: 690 - protein, 549 aa, Arabidopsis thaliana
  G3041
MGRGSVTSLAPGFRFHPTDEELVRYYLKRKICNKPFKFDAISVTDVYKSEPWDLPDKSRLKSRDLEWYFFSMLDKKYRNGSKTNRATEMGYWKTTGKDREILNGSKVVGMKKTLVYHKGRAPRGERTNWVMHEYRLVDQDLDKTGVHQDAFVLCRIFQKSGSGPKNGEQYGAPFVEEEWEEEDDMTFVPDQEDLGSEDHVYVHMDDIDQKSENFVVYDAIPIPLNFIHGESSNNVETNYSDSINYIQQTGNYMDSGGYFEQPAESYEKDQKPIIRDRDGSLQNEGIGCGVQDKHSETLQSSDNIFGTDTSCYNDFPVESNYLIGEAFLDPNSNLLENDGLYLETNDLSSTQQDGFDFEDYLTFFDETFDPSQLMGNEDVFFDQEELFQEVETKELEKEETSRSKHVVEEKEKDEASCSKQVDADATEFEPDYKYPLLKKASHMLGAIPAPLANASEFPTKDAAIRLHAAQSSGSVHVTAGMITISDSNMGWSYGKNENLDLILSLGLVQGNTAPEKSGNSSAWAMLIFMCFWVLLLSVSFKVSILVSSR

SEQ ID NO: 691 - DNA, 812 bp, Medicago truncatula
  G3362
ttactaaccacactgttcttcaactagtagaattataacaaactttccttctactattcttttttttttttttttggaacatgtttactatgaatcaattttcggagtcacatgatccatgttcatcatcttcagagaggtttcttgcagagaccatgccaaagaagcgtgcagggaggaagaagttcagagaaacacgccaccctgtgtaccgtggtgtaagaaaaagggattccgggaagtgggtttgcgaagtaagagaacctaacaagaaaaccagaatttggcttggaacattccctacaccggagatggcggcgcgtgcgcatgatgtcgctgcgattgcactgagaggaaggtctgcttgtcttaactttgctgattctgcttggaagttgccggttccggctacgtcggaagcaagggatattcaaaaggcggcggctgaggcagcggaggctttcaggccggagagtgtgtttgagaatagtgaagagaggaaggatagtgagccttcgtcgacagtggcggtgtcggagacggtgatggagcaacgggaggaggaagaggatacggtgccggagtatttgagaaacatggtgctaatgtcaccggcacattactggggaagtgattgtggtgttgctgacgtggaatttgatgaaactgaagtttcattgtggagttactcattttaatttaatttaagataaatatctaaacattagtacattactagtaccaaattgaggaataaattgtttgtgcaggaagttcgtactaggatagtgtcttaacaaaaaaaaaaaagg

SEQ ID NO: 692 - protein, 205 aa, Medicago truncatula
  G3362
MFTMNQFSESHDPCSSSSERFLAETMPKKRAGRKKFRETRHPVYRGVRKRDSGKWVCEVREPNKKTRIWLGTFPTPEMAARAHDVAAIALRGRSACLNFADSAWKLPVPATSEARDIQKAAAEAAEAFRPESVFENSEERKDSEPSSTVAVSETVMEQREEEEDTVPEYLRNMVLMSPAHYWGSDCGVADVEFDETEVSLWSYSF

SEQ ID NO: 693 - DNA, 820 bp, Medicago truncatula
  G3364
tctttccttcaaaaccaagtatgcttcactatatatgtaacacaccttactcttcattctcttaaaaacaactatctctccaacacatacatatgtttactactaacaactcttcctattcacactccatttcctcagaagcatcttcttcctactataactcattaccggaatcggagatacgattagcagctagtaacccgaagaagagagcagggaggaagatattcaaggaaactcgccacccggtgtatagaggtgtaaggaagaggaacttagataaatgggtttgtgaaatgagggaacccaacacgaagactagaatttggctaggaacttttccaacagccgagatggcagcccgagcccacgatgttgctgcgatggcattgaggggtcgctacgcctgtctcaattttgcagattcggtgtggcggcttcctattccagcaacttcctcaataaaagatattcaaaaggcagctacaaaagccgccgaagcttttagaccagacaatactataatgattaccaacattgagactgttgtagctgttgtcgccacaaaggagttgaatatgttttgtgtggaagaagaagaggaaatgttgaatatgccggagttttggaggaatatggcactaatgtcccctacacatagctttgagtatcatgatcaatatgaagattttcattttcaagactttcaagatgatgaggtatcactatggaacttctaaattttctttgtttggtttaactttatttttggattgtagaataggaaatgtctatactacaacctttttaattggtagca

SEQ ID NO: 694 - protein, 215 aa, Medicago truncatula
  G3364
MFTTNNSSYSHSISSEASSSYYNSLPESEIRLAASNPKKRAGRKIFKETRHPVYRGVRKRNLDKWVCEMREPNTKTRIWLGTFPTAEMAARAHDVAAMALRGRYACLNFADSVWRLPIPATSSIKDIQKAATKAAEAFRPDNTIMITNIETVVAVVATKELNMFCVEEEEEMLNMPEFWRNMALMSPTHSFEYHDQYEDFHFQDFQDDEVSLWNF

SEQ ID NO: 695 - DNA, 747 bp, Medicago truncatula
  G3365
cacgaggcgcataaaccataagctactttactactagtactactacatacaccccacaaatgaaatcatcacttgatgagtctagttacgtagagaacaactcttcttcatcagaaatcttgttagcatcagaacaaccaaagaaacgtgcgggtcgacgaaaattcaaggagacaagacatccagtatacagaggagtacgaagaaggaacaacaacaacaacaagtgggtttgtgaagtgcgtgttcctaacgacaagtccacgaggatttggcttggaacatatccaacacctgagatggcagcacgtgcacacgacgttgccgcactggcacttcgcggtaaatcagcttgtcttaattttgctgactctgcgtggcggttagcgttgccggcgacgaacaatgcgaaggagattaggaaaatggcggcggaggctgctttggcatttgccgtagttgcggacagtaaggaacaaactatgattagtaattgtgatgttaatagtgttggtgttatggaagttgataataaacctttgcagggactgtgtgtggaagttccagaggaggaaatgttgcatgattggtttaggagtatggctgatgagccattacgatctcctattactccatttataagacatggcagggatcagtggaataatgttgatattgatcaggttgatgctgaggtctccttgtggaactttaccatctaatctatgagatgcattttgctttttg

SEQ ID NO: 696 - protein, 220 aa, Medicago truncatula
  G3365
MKSSLDESSYVENNSSSSEILLASEQPKKRAGRRKFKETRHPVYRGVRRRNNNNNKWVCEVRVPNDKSTRIWLGTYPTPEMAARAHDVAALALRGKSACLNFADSAWRLALPATNNAKEIRKMAAEAALAFAVVADSKEQTMISNCDVNSVGVMEVDNKPLQGLCVEVPEEEMLHDWFRSMADEPLRSPITPFIRHGRDQWNNVDIDQVDAEVSLWNFTI

SEQ ID NO: 697 - DNA, 931 bp, Medicago truncatula
  G3366
caaaaacaacaacatctttacttcataataacaaacacttatcttcagttccaactttcactatcaaattcttttcccactctcaccaacacaatcatatgtatccaactacaaactctgtctcttcctcttcctccgacatgtcgctgccgaattcagagggctctcattggatgtcaatttgcaacgaggagatgcgattagcggcaactaccccgaagaagcgtgcagggaggaagaagttcaaggaaactcgccacccagtctatagaggagtgaggaagaggaacttagataaatgggtttgtgaaatgagggagcctaacaagaagactaagatttggctagggacttttccaactgccgagatggcagcccgtgcccacgatgttgctgcaatggcattgaggggccgctacgcttgtctcaactttgcagactcagcgtggcggctccccaaacctgcaactactcaagcaaaggatatacaaaaggctgctacagaggccgccgaggctttcagaccagacaagactttattgactaatcacaatgacaatgacaatgacaatgacaaagagaatgacatggctgtagttgccactgccactgaggagcagagtatgatttgtatggaagagaaagaagaaggagtgatgaacatgcaagagatgtggagtaatatggcgctaatgtctcctacacatagcttggggtattatgagtatcaatatattaatgaagactttcaagatgaggaagtatcactatggagtttttaaattttttgtaggaaaatggaattttttagtttgatccgtttggtttacatttatttattttttgattgtagaatggaaattgtaaaatagtacaaacctttttagtagtagtacggattcttgataggtttaaattggaaagaaaaaaa

SEQ ID NO: 698 - protein, 227 aa, Medicago truncatula
  G3366
MYPTTNSVSSSSSDMSLPNSEGSHWMSICNEEMRLAATTPKKRAGRKKFKETRHPVYRGVRKRNLDKWVCEMREPNKKTKIWLGTFPTAEMAARAHDVAAMALRGRYACLNFADSAWRLPKPATTQAKDIQKAATEAAEAFRPDKTLLTNHNDNDNDNDKENDMAVVATATEEQSMICMEEKEEGVMNMQEMWSNMALMSPTHSLGYYEYQYINEDFQDEEVSLWSF

SEQ ID NO: 699 - DNA, 1271 bp, Medicago truncatula
  G3367
aaacaaactctctccaattaccactttacctctcaaaaccattttccactctatccaacacatacatatgataagtactaacaactcttcctattcacactccatttcctcaaaagatttttctcccttcgacgcatcatcaccggattctgaggtgcggttagcatcaagcaacccgaagaagagagcggggaggaagatatttaaggaaactcgtcaccctgtctatagaggtgtgaggaagaggaacttaaataaatgggtttgtgaaatgagggagccgaacacaaagaataggatttggctaggaacttttccaacagccgagatggcagcccgagcccacgatgttgccgcgatagcattgaggggccgctatgcctgtctcaattttgcagactcggtgtggcgccttcctattccagcaacttccgcgataaaagatattcaaaaggcagctacaaaagccgccgaagcttttagaccagacaatactttaatgaccagtgacattgacaccgttgtagctgttgtcgcaacacaggagctgaatatgtttcgtgttgaagtcgaagaagaggaagtgttgaatatgccagagttgtggaggaatatggcactaatgtcccctacacatagctttgggtatcatgatcagtatgaagatattcatatacaagactttcaagatgatgaggtatcactatggaacttttaaatttaattgatttggttttacatttatttttggattgtagaataggaaatgtctatactacaaccgtttgaattggtagcgtaaactctgcatatacataggttgaatttgaaaaggaatttatttttatagcttttatgtgaattattaaatcactaatcaagcgtaaagtgcatctcatcctttttattatatatgaaagaaaatataattttggaatttcagctattgatatagaaaatataatctattgccatctttgcttagcctgtattaagttgaagaaggtaatacggtgtctcttgtcttattcttctcttctcttttgtaggactttaaaaaaaggtctgttacgacgatctgggctgtgacttcaattggggtgcattcgctgcatttcaccgtcatatcaaggattgtgatgcgaaccttgcttttatgtgtctgatttctgtgttttcatcctggcaaggaaagctacaagagaagaatgaatgaaatttaagcagatgccagtaattaatatcctctgcaatttcctcatgtatttggt

SEQ ID NO: 700 - protein, 216 aa, Medicago truncatula
  G3367
MISTNNSSYSHSISSKDFSPFDASSPDSEVRLASSNPKKRAGRKIFKETRHPVYRGVRKRNLNKWVCEMREPNTKNRIWLGTFPTAEMAARAHDVAAIALRGRYACLNFADSVWRLPIPATSAIKDIQKAATKAAEAFRPDNTLMTSDIDTVVAVVATQELNMFRVEVEEEEVLNMPELWRNMALMSPTHSFGYHDQYEDIHIQDFQDDEVSLWNF

SEQ ID NO: 701 - DNA, 795 bp, Medicago truncatula
  G3368
accaaccaaaaaaaaatcccaatctaaattcgaaaaatggatttcttcatgtcatcatttagtgattactcagacacttcttcatcagaaacagcttcatcaaaccgtacaagttcttcagaagtgattttggcacctgcaagaccaaagaagagagcaggtagaagagtgttcaaggagacaagacatccggtgtaccgaggagtacgacgtaggaagaataacaagtgggtttgtgagatgagagttcctaacaatatcgttaacaaaaataataagtcaaggatttggcttggaacatatccaactcctgaaatggctgcacgtgcacatgatgttgctgcacttactcttaaaggaaaatcagcttgtcttaattttgctgactctgcatggcggttgaggttgccggagtcgaatgatgcgacggagataaggagggcggcgatggaggctgctcagttgtttgcggttgaagacaagcaatgttgtgttaccgttgaagatggagtgtttatggacatggaagattccaagaatatgctagaagcacaggttccagtggtgtcatcagaatttgaagacatgcatcatttgcttctaagtattgccaatgagcctttacgttcagctcctccttccccaacaaattatggtagttataactggggtgacatggagatttttgatactcaattagtttcactttggaacttctctatttgatactcttcttggatgtggttgattttgtaaaacttattttttagttcagtttgaaatgaagtcacattt

SEQ ID NO: 702 - protein, 229 aa, Medicago truncatula
  G3368
MDFFMSSFSDYSDTSSSETASSNRTSSSEVILAPARPKKRAGRRVFKETRHPVYRGVRRRKNNKWVCEMRVPNNIVNKNNKSRIWLGTYPTPEMAARAHDVAALTLKGKSACLNFADSAWRLRLPESNDATEIRRAAMEAAQLFAVEDKQCCVTVEDGVFMDMEDSKNMLEAQVPVVSSEFEDMHHLLLSIANEPLRSAPPSPTNYGSYNWGDMEIFDTQLVSLWNFSI

SEQ ID NO: 703 - DNA, 1270 bp, Medicago truncatula
  G3369
actcacagtttaactgtttacttcatttttccttcaaactatgcttccttataaatataccacctttctcttggttttcttaaatctcaacaccaaaatttcaacctctttactctataacaaactcttatcttcaattctagatttcactatcaaaacctttttctactatctccagcacatggatatgtttacaaataataactcctattcacaccccttttctccaacttgctccgagagttcattcccgaattcagagggctcgcaagggatgtcaatttccaacgaggaggtgaggttagcagcgactactccaaagaagcgtgcagggaggaagaagttcaaggagactcgccacccggtatataggggtgtgaggaaaagaaacttagataaatgggtgtgtgaaatgagggaaccaaataagaagactaaaatttggctaggcacttttccaactgcggagatggcagcccgagcacatgatgttgccgcaatggcattgaggggccgctacgcctgtctcaactttgcagactccgcgtggcggctccctatacctgccaccactcaggcaaaagatatacaaaaggcggctgcacaggccgctgaggctttcagaccagacaagacttcaattactaatgacattgacacggctatttccacctctgctacggcggaacagagtaggacttttatggaagaggaagaagagggggtgatgaacatgccagagttgttgaggaatatggcactaatgtctcctacacatagctctgggtataatgaatatgaaaatattcatgttcaagactttcaagatttacaagattttcaagatgaagaggtatcactgtggaatttttaatttttaattttcttttgatgaatagctttattatatatggtgtgttggtttattattttttatctctgaattgtagaacagaactttctgttctacaaccatttttattagtagtactgattcttcatatatacatatgttgaaattgaaaagcaaattctttttgcattcttttctgtaatgcaggtattaatcaagcataaagtgcttctcatcccttctattagtatatatgaaagaagaatagaagtttggtatgtcaaaatcagtgtcaacttcattagctatttaaattaagttaaaggaggtaattaaaatctgtgtctctcttctttttcttctcttatattatcatttgtaggattttaaaaaatagtttgtaaccgtaatttgggt

SEQ ID NO: 704 - protein, 277 aa, Medicago truncatula
  G3369
MLPYKYTTFLLVFLNLNTKISTSLLYNKLLSSILDFTIKTFFYYLQHMDMFTNNNSYSHPFSPTCSESSFPNSEGSQGMSISNEEVRLAATTPKKRAGRKKFKETRHPVYRGVRKRNLDKWVCEMREPNKKTKIWLGTFPTAEMAARAHDVAAMALRGRYACLNFADSAWRLPIPATTQAKDIQKAAAQAAEAFRPDKTSITNDIDTAISTSATAEQSRTFMEEEEEGVMNMPELLRNMALMSPTHSSGYNEYENIHVQDFQDLQDFQDEEVSLWNF

SEQ ID NO: 705 - DNA, 845 bp, Oryza sativa
  G3370
tccaactccaagtctccaacctcagctcagctcaagctcgccggcgaagtgaaccagagagagtcatccatggaggtggaggaggcggcgtacaggacggtgtggtcggagccgccgaagaggccggcgggaaggaccaagttcagggagacgaggcacccggtgtaccgcggcgtgcggcggcgcggggggcggccgggcgcggcggggaggtgggtgtgcgaggtgcgggtgcccggggcgcgcggctccaggctgtggctcggcacgttcgccaccgccgaggcggcggcgcgcgcgcacgacgccgccgcgctggcgctccgcggcagggccgcctgcctcaacttcgccgactccgcgtggcggatgccgcccgtccccgcgtccgccgcgctcgccggcgcgaggggggtcagggacgccgtcgccgtggccgtcgaggcgttccagcgccagtcggccgcgccgtcgtctccggcggagaccttcgccgacgatggcgacgaagaagaagacaacaaggacgtgttgccggtggcggcggcggaggtgttcgacgcgggggcgttcgagctcgacgacgggttcaggttcggcgggatggacgccgggtcgtactacgcgagcttggcgcaggggctgctcgtcgagccgccggccgccggagcgtggtgggaggacggcgagctcgccggctccgatatgccgctctggagctactaatcaaaatctcgcactgaaaagtgtggacaaattttgattctccagaaattgggggaaaaaagagaacagagtattggtgaatttagaacagagtaggcaatgagactgaggatgaatgg

SEQ ID NO: 706 - protein, 218 aa, Oryza sativa
  G3370
MEVEEAAYRTVWSEPPKRPAGRTKFRETRHPVYRGVRRRGGRPGAAGRWVCEVRVPGARGSRLWLGTFATAEAAARAHDAAALALRGRAACLNFADSAWRMPPVPASAALAGARGVRDAVAVAVEAFQRQSAAPSSPAETFADDGDEEEDNKDVLPVAAAEVFDAGAFELDDGFRFGGMDAGSYYASLAQGLLVEPPAAGAWWEDGELAGSDMPLWSY

SEQ ID NO: 707 - DNA, 1103 bp, Oryza sativa
  G3371
ccatcaacaccgagatcgactcgacgcctctaccatcaagtcgctgccgtcggtgatgacggtgcgcagctgtggccaacgggggaggcagaggaggtacgcacggatgccctcgcccccgtcgtcgccgccgccaacactaaccaactgcttgagacgtcgcacacgtcatggagaagaacaccgccgccagcgggcaattgatgacctcctccgcggaggcgacgccgtcgtcgccgaagcggccggcggggcgaaccaagttccaggagacgaggcacctagtgttccgtggggtgcgatggcgtgggtgcgcggggcggtgggtgtgcaaggtgcgtgtcccgggcagccgcggtgaccgtttctggataggcacgtctgacaccgccgaggagaccgcgcgcacgcacgacgccgccatgctcgccttgtgcggggcctccgccagcctcaacttcgccgactctgcctggctgctccacgtcccgcgcgcccccgtcgtctccggactccggccaccagctgcccgatgtgcaacgcgctgcctgcaaggccatcgccgagttccagcgccgggccgggggagcaacgccactgccactgccacctccggcgatgctgcatcgaccgctcctccgtcggcacccgttctgtcagccaaacaatgcgaattcatctttctttcttcactagattgttggatgttaatgtcaaagcttatcagcagtagcagagcaaaaggatcgttgtgcctgcgaaaaaatcccatttcattttgcatggttacaaattcttacactgctcttttgctcgaatacattatattgcagatgaattcaatgatcgttttaatccacgaattatcaaaatatcaagtctttctgctactaaccatgataacacaccacctttttcaatggaggaggtaggcgcggacgccctcgccatcatcgtcgatgtcgccactgatgacgaggtccgcgccgctcaccagctcgcacgcctcgtcgtcgtccatgctcgccacctcggtccagcagctgaaccgcctggcgacgtcctctcacctcagtcctccctcccagtgagcgaacaatgag

SEQ ID NO: 708 - protein, 253 aa, Oryza sativa
  G3371
MEKNTAASGQLMTSSAEATPSSPKRPAGRTKFQETRHLVFRGVRWRGCAGRWVCKVRVPGSRGDRFWIGTSDTAEETARTHDAAMLALCGASASLNFADSAWLLHVPRAPVVSGLRPPAARCATRCLQGHRRVPAPGRGSNATATATSGDAASTAPPSAPVLSAKQCEFIFLSSLDCWMLMSKLISSSRAKGSLCLRKNPISFCMVTNSYTALLLEYIILQMNSMIVLIHELSKYQVFLLLTMITHHLFQWRR

SEQ ID NO: 709 - DNA, 698 bp, Oryza sativa
  G3372
ccagcagcagcaacacacactactgacatggagtactacgagcaggaggagtacgcgacggtgacgtcggcgccgccgaagcggccggcggggaggaccaagttcagggagacgaggcacccggtgtaccgcggcgtgcggcggcgggggcccgcggggcggtgggtgtgcgaggtcagggagcccaacaagaagtcccgcatctggctcggcaccttcgccaccgccgaggccgccgcgcgcgcccacgacgtcgccgcgctcgccctccgcggccgcggcgcgtgcctcaacttcgccgactcggcccgcctcctccgcgtcgacccggccaccctcgccacccccgacgacatccgccgcgccgccatcgagctcgccgagtcatgcccgcacgacgccgccgccgccgccgcctccagctccgccgccgccgtcgaggcctccgccgccgccgcgcccgccatgatgatgcagtaccaggacgacatggcggcgacgccgtccagctacgactacgcgtactacggcaacatggacttcgaccagccgtcctactactacgacgggatgggcggcggcggcgagtaccagagctggcagatggacggcgacgacgatggtggcgccggcggctacggcggcggcgacgtcacactctggagctactgatgatcgcgagttggagctagcagttt

SEQ ID NO: 710 - protein, 214 aa, Oryza sativa
  G3372
MEYYEQEEYATVTSAPPKRPAGRTKFRETRHPVYRGVRRRGPAGRWVCEVREPNKKSRIWLGTFATAEAAARAHDVAALALRGRGACLNFADSARLLRVDPATLATPDDIRRAAIELAESCPHDAAAAAASSSAAAVEASAAAAPAMMMQYQDDMAATPSSYDYAYYGNMDFDQPSYYYDGMGGGGEYQSWQMDGDDDGGAGGYGGGDVTLWSY

SEQ ID NO: 711 - DNA, 813 bp, Oryza sativa
  G3373
cactaatccctcctctcatcgcaccaccacgccactgagctcaagctaagctaagtgctaacctaggtgttcgaccatggacaccgaggacacgtcgtcggcttcgtcctcgtcggtgtcgccgccgtcgtcgccgggcggcgggcaccaccaccggctgccgccgaagcggcgggcggggcggaagaaattccgggagacgcggcacccggtgtaccgcggcgtgcgcgcgcgggcgggggggagcaggtgggtgtgcgaggtgcgcgagccgcaggcgcaggcgcgcatctggctcggcacctacccgacgccggagatggcggcgcgcgcgcacgacgtcgcggccatcgccctccgcggcgagcgcggcgccgagctcaacttcccggactccccctccacgctcccgcgcgcgcgcacggcgtcgcccgaggacatccgcctcgccgccgcgcaggccgccgagctgtaccgccgcccgccgccgccgctggcattgccggaggatccgcaggaaggcacgagcggcggcggcgccaccgccacctcggggcgtccggctgccgtgttcgtggacgaggacgccatcttcgacatgccggggctgatcgacgacatggcgagggggatgatgctgacgccgccggcgattgggagatctctcgacgactgggccgccatcgacgacgacgatgaccattaccacatggactacaagctatggatggactgacatgtatacacacatatcgttcgagtatatatgcttacagatatagataatactccatcagttcctactaaatacgg

SEQ ID NO: 712 - protein, 219 aa, Oryza sativa
  G3373
MDTEDTSSASSSSVSPPSSPGGGHHHRLPPKRRAGRKKFRETRHPVYRGVRARAGGSRWVCEVREPQAQARIWLGTYPTPEMAARAHDVAAIALRGERGAELNFPDSPSTLPRARTASPEDIRLAAAQAAELYRRPPPPLALPEDPQEGTSGGGATATSGRPAAVFVDEDAIFDMPGLIDDMARGMMLTPPAIGRSLDDWAAIDDDDDHYHMDYKLWMD

SEQ ID NO: 713 - DNA, 892 bp, Oryza sativa
  G3374
accacaaacacctccatcaccaccaccacggcaccaccacctccaaattccaatgtgtacgagcaaactagaggagatcaccggcgagtggccgccgccggcattgcaggccgcctccacgacgtcgtcgtcggagccgtgccgccgcctctcgccgcccagcagcaagcgccccgcggggcgcaccaagttccacgagacccgccacccggtgttccgcggcgtgcggcgccgcggccgcgcggggcggtgggtgtgcgaggtccgcgtgccgggccgccgcgggtgcaggctctggctcggcacgttcgacgccgccgacgccgccgcgcgcgcccacgacgccgccatgctcgcgctccgcggccgcgccgccgcgtgcctcaacttcgccgactccgcctggctgctcgccgtgccgcccccggccaccctccgctgcgccgccgacgtccagcgcgccgtggcgcgggcgctggaggacttcgagcagcgggagtcatcatcgtccgtgttcccactcgccatcgacgtcgtcgccgaggacgccatgtccgccacgtccgagccgtccgccgcgagcgacgacgacgccgtcaccagcagcagcagcacgaccgacgccgacgaggaggcatcaccgttcgagctggatgtggtgagcgacatgggctggagcctgtactacgcgagcttagcggagggcctcctcatggagccgccggcttccggcgcatcgtccgacgacgacgacgacgccatcgtcgactcaggcgacatcgctgacgtgtctctgtggagctactagcattgaagcagacgcgcgtcatgctcttgtacataaaagagtgacttcctaattaacagcagctgagcatgtatggccttgtat

SEQ ID NO: 714 - protein, 251 aa, Oryza sativa
  G3374
MCTSKLEEITGEWPPPALQAASTTSSSEPCRRLSPPSSKRPAGRTKFHETRHPVFRGVRRRGRAGRWVCEVRVPGRRGCRLWLGTFDAADAAARAHDAAMLALRGRAAACLNFADSAWLLAVPPPATLRCAADVQRAVARALEDFEQRESSSSVFPLAIDVVAEDAMSATSEPSAASDDDAVTSSSSTTDADEEASPFELDVVSDMGWSLYYASLAEGLLMEPPASGASSDDDDDAIVDSGDIADVSLWSY

SEQ ID NO: 715 - DNA, 765 bp, Oryza sativa
  G3375
ctttcctcccaaatcaagaccaaatcggataatttcaaatccttgtcgagtgaactgatccatcgatggagtgggcgtactacggcagtgggtactcctcgtcggggacgccgtcgccggtgggcggcgacggggacgaggactcgtacatgacggtgtcgtcggcgccgcccaagcggcgggcggggaggaccaagttcaaggagacgaggcacccggtgtacaagggcgtgcgcagcaggaaccccgggaggtgggtctgcgaggtgcgcgagccgcacggcaagcagaggatctggctcggcaccttcgagaccgccgagatggcggcgcgcgcgcacgacgtcgcggcgatggcgctgcgcggccgcgccgcctgcctcaacttcgccgactcgccgcgcaggctccgcgtgccgccgctgggggccgggcacgaggagatacgccgcgccgcggtcgaggccgccgagctgttccgcccggcgcccgggcagcacaatgcggctgccgaggcggcggccgctgtcgctgcgcaggcaaccgcggcgagcgcggagctctttgccgacttcccttgctacccgatggacggactggaattcgaaatgcaggggtacctcgacatggcacagggaatgctcatcgagccgccgccattggcagggcaatcgacgtgggccgaggaggactacgactgcgaggtcaatctatggagctactgatgatcgcccgtgcacctgaaccgaaccagccctgatgagc

SEQ ID NO: 716 - protein, 219 aa, Oryza sativa
  G3375
MEWAYYGSGYSSSGTPSPVGGDGDEDSYMTVSSAPPKRRAGRTKFKETRHPVYKGVRSRNPGRWVCEVREPHGKQRIWLGTFETAEMAARAHDVAAMALRGRAACLNFADSPRRLRVPPLGAGHEEIRRAAVEAAELFRPAPGQHNAAAEAAAAVAAQATAASAELFADFPCYPMDGLEFEMQGYLDMAQGMLIEPPPLAGQSTWAEEDYDCEVNLWSY

SEQ ID NO: 717 - DNA, 759 bp, Oryza sativa
  G3376
atcaacctcgctcgcttactcgtgtttaggcatggacgtttctgctgcgctcagcagcgactactcgtcggggacgccgtcgccggtggcggccgacgctgacgacggctcctccgcctacatgacggtgtcgtcggcgccgcccaagcggcgggcggggcggaccaagttcaaggagacgcggcaccccgtgttcaagggcgtgcgccggaggaaccccgggaggtgggtgtgcgaggtgcgcgagccgcacggcaagcagcggatatggctcgggacgttcgagacagcagagatggcggcgcgcgcgcacgacgtcgccgcgctcgcgctccgcggccgcgccgcctgcctcaacttcgccgactcgccgaggcgcctccgcgtcccgcccatcggcgcaagccacgacgacatacggagggcggcggctgaggcggccgaggcattccggccgccaccagatgagagcaatgcggccaccgaggtggcagccgccgcatcgggcgccactaattcgaacgccgaacagttcgcctcccacccgtactacgaggtcatggacgatgggctggacttggggatgcagggctacctcgacatggcgcaagggatgctcattgacccgcctccaatggcctgtgatcctgccgtaggtggcggcgaagacgacaacgatggcgaggtccagctatggagctactgatcctgcgcgtttgaactcaacttggtttggcgcgaagagatcgcatgtacagc

SEQ ID NO: 718 - protein, 224 aa, Oryza sativa
  G3376
MDVSAALSSDYSSGTPSPVAADADDGSSAYMTVSSAPPKRRAGRTKFKETRHPVFKGVRRRNPGRWVCEVREPHGKQRIWLGTFETAEMAARAHDVAALALRGRAACLNFADSPRRLRVPPIGASHDDIRRAAAEAAEAFRPPPDESNAATEVAAAASGATNSNAEQFASHPYYEVMDDGLDLGMQGYLDMAQGMLIDPPPMACDPAVGGGEDDNDGEVQLWSY

SEQ ID NO: 719 - DNA, 847 bp, Oryza sativa
  G3377
cgccgccaacaccaaccaactgcggcttgagacgtcgcgcgcgacatggagaagaacaccaccgccatggggcaattgatgagctcctccgcgacgacggcggcgacggcgacggggccggcgtcgccgaagcggccggcggggcggaccaagttccaggagacgaggcacccggtgttccgcggggtgcggcggcgcgggcgcgcggggcggtgggtgtgcgaggtgcgcgtcccgggcagccgcggcgaccgcctgtgggtcggcacgttcgacaccgccgaggaggccgcgcgcgcgcacgacgccgccatgctcgccctgtgcggggcctccgccagcctcaacttcgccgactccgcctggctgctccacgtcccccgcgcccccgtcgcctccggccatgaccagctgcccgacgtgcagcgcgccgccagcgaggccgtcgccgagttccagcgccggggaagtactgccgccactgccaccgccacctccggcgacgccgcatccaccgctcctccgtcgtcgtcgcccgttctgtcacccaacgacgacaatgcctcgtcggcgtccactcctgcggtggcggcggcgttggaccacggcgacatgttcggtggcatgcgcaccgatctgtacttcgcgagcttggcgcagggtctgctcatcgagccgccgccgccgccgaccaccgctgagggtttctgcgacgacgaaggatgcggcggcgctgaaatggagctgtggagctagcatcaaattaaccaaacaatcttcactagcttgttggatgtagtagtagcagttctagctagcacaagtgcagaacacaaaaggatcgttt

SEQ ID NO: 720 - protein, 236 aa, Oryza sativa
  G3377
MEKNTTAMGQLMSSSATTAATATGPASPKRPAGRTKFQETRHPVFRGVRRRGRAGRWVCEVRVPGSRGDRLWVGTFDTAEEAARAHDAAMLALCGASASLNFADSAWLLHVPRAPVASGHDQLPDVQRAASEAVAEFQRRGSTAATATATSGDAASTAPPSSSPVLSPNDDNASSASTPAVAAALDHGDMFGGMRTDLYFASLAQGLLIEPPPPPTTAEGFCDDEGCGGAEMELWS

SEQ ID NO: 721 - DNA, 949 bp, Oryza sativa
  G3378
gttgtcaccagctgttctctcccatggcttccctgcgtcccaaccctcgccgcccaaatgcatacctatatatatactcctcgcgccgccgagctcgagcactctcactctgcaagcgcgacgcgttctcactcgctcggacaagctcctccatctctcgatcgctcacgagcagcaatggacatggccggccacgaggtgaactccagctcgtcgtcgtcgggggcggagtcgtcgtcgtcctcgtcggggcggcagcagtacaagaagcggcccgcggggcgcaccaagttcagggagacgcggcacccggtgtaccgcggcgtgcggcgccgcggcggggcggggcggtgggtgtgcgaggtgcgcgtcccggggaagcgcggcgcgcgcctgtggctcggcacgtacgtcaccgccgaggccgcggcgcgcgcgcacgacgccgccatgatcgcgctccgcggcggcgccggcggaggcggcgcggcgtgcctcaacttccaggactccgcgtggctgctcgccgtcccgcccgccgcgccgtccgacctggccggcgtccgccgcgcggccaccgaggccgtcgcgggcttcctccagcgcaacaagaccacgaacggcgcctccgtcgcggaggccatagacgaggccacctccggcgtgtccaagccgccgccgctggccaacaatgccgactcatcggagacgcccggaccttcatcgatcgacggaacggctgacacggcggcgggggcggcgctggacatgttcgagctcgacttcttcggcgaaatggactacgacacgtactacgcgagcctggccgaggggcttctcatggagccgccgccggcggcgaccgcactctgggacaacggcgacgaaggcgctgacatcgcgctctggagctactgagctctgacactgtctccagttgactgtactc

SEQ ID NO: 722 - protein, 286 aa, Oryza sativa
  G3378
MHTYIYTPRAAELEHSHSASATRSHSLGQAPPSLDRSRAAMDMAGHEVNSSSSSSGAESSSSSSGRQQYKKRPAGRTKFRETRHPVYRGVRRRGGAGRWVCEVRVPGKRGARLWLGTYVTAEAAARAHDAAMIALRGGAGGGGAACLNFQDSAWLLAVPPAAPSDLAGVRRAATEAVAGFLQRNKTTNGASVAEAIDEATSGVSKPPPLANNADSSETPGPSSIDGTADTAAGAALDMFELDFFGEMDYDTYYASLAEGLLMEPPPAATALWDNGDEGADIALWSY

SEQ ID NO: 723 - DNA, 895 bp, Oryza sativa
  G3379
cactcgagcagagcaaatacagttcaggaatcaggagcaagcagaaacacacacacaaatccgaagatgtgcgggatcaagcaggagatgagcggcgagtcgtcggggtcgccgtgcagctcggcgtcggcggagcggcagcaccagacggtgtggacggcgccgccgaagaggccggcggggcggaccaagttcagggagacgaggcacccggtgttccgcggcgtgcggcggaggggcaatgccgggaggtgggtgtgcgaggtgcgggtgcccgggcggcgcggctgcaggctctggctcggcacgttcgacaccgccgagggcgcggcgcgcgcgcacgacgccgccatgctcgccatcaacgccggcggcggcggcggcgggggagcatgctgcctcaacttcgccgactccgcgtggctcctcgccgtgccgcgctcctaccgcaccctcgccgacgtccgccacgccgtcgccgaggccgtcgaggacttcttccggcgccgcctcgccgacgacgcgctgtccgccacgtcgtcgtcctcgacgacgccgtccaccccacgcaccgacgacgacgaggagtccgccgccaccgacggcgacgagtcctcctccccggccagcgacctggcgttcgaactggacgtcctgagtgacatgggctgggacctgtactacgcgagcttggcgcaggggatgctcatggagccaccatcggcggcgctcggcgacgacggtgacgccatcctcgccgacgtcccactctggagctactagagctcaatcaactgtacaattttgcctcttttttctctcttttctggcttccgatgccaaaattttggtactgtacggacactactttcggtaatgtgatggaacaagttgc

SEQ ID NO: 724 - protein, 238 aa, Oryza sativa
  G3379
MCGIKQEMSGESSGSPCSSASAERQHQTVWTAPPKRPAGRTKFRETRHPVFRGVRRRGNAGRWVCEVRVPGRRGCRLWLGTFDTAEGAARAHDAAMLAINAGGGGGGGACCLNFADSAWLLAVPRSYRTLADVRHAVAEAVEDFFRRRLADDALSATSSSSTTPSTPRTDDDEESAATDGDESSSPASDLAFELDVLSDMGWDLYYASLAQGMLMEPPSAALGDDGDAILADVPLWSY

SEQ ID NO: 725 - DNA, 966 bp, Oryza sativa
  G3384
atggggaggccgccgtgctgcgacaaggtcggggtgaagaaggggccatggacgccggaggaggacctgatgctggtctcctacatccaggagcacggcgccggcaactggcgcgccgtgccgacgaacaccgggctgatgcgttgcagcaagagctgccggctccggtggacgaactacctcaggccggggatcaagcgggggaacttcaccgagcaggaggagaagctcatcgtccacctccaggctctcctcggcaaccggtgggcagcgatagcgtcgtacttgccggagaggacggacaacgacatcaagaactactggaacacgcacctcaagaagaagctcaagaagatgcaggccgccggaggtggggaagacagcggcgccgcctcggagggtggcggcggccgcggcgacggcgacggcggcgggaaaagcgtgaaggccgccgcacctaaggggcagtgggagcggcggctgcagacggacatccacacggcgcggcaggcgctgcgcgacgcgctctcgctcgaccaccccgacccgtcgccggcgacggcggcggcggcggcgacgccagcggggtcgtcggcggcgtacgcgtcgagcgcggacaacatcgcgcggctgctgcagggctggatgcgcccgggcggcggcggcggcggcaacggcaagggccccgaggcgtcggggtcgacctccacgacggcgacgacgcagcagcagccgcagtgctccggcgagggcgcggcatccgcgtccgcgtcggcgagccagagcggcgccgccgccgcggcgactgcccagacgccggagtgctcgacggagacgagcaagatggccaccggcggcggcgccggcggccccgcgccggcgttctcgatgctggagagctggctgctcgacgacggcggcatggggctcatggacgtggtgccattgggggaccccagtgagtaa

SEQ ID NO: 726 - protein, 321 aa, Oryza sativa
  G3384
MGRPPCCDKVGVKKGPWTPEEDLMLVSYIQEHGAGNWRAVPTNTGLMRCSKSCRLRWTNYLRPGIKRGNFTEQEEKLIVHLQALLGNRWAAIASYLPERTDNDIKNYWNTHLKKKLKKMQAAGGGEDSGAASEGGGGRGDGDGGGKSVKAAAPKGQWERRLQTDIHTARQALRDALSLDHPDPSPATAAAAATPAGSSAAYASSADNIARLLQGWMRPGGGGGGNGKGPEASGSTSTTATTQQQPQCSGEGAASASASASQSGAAAAATAQTPECSTETSKMATGGGAGGPAPAFSMLESWLLDDGGMGLMDVVPLGDPSE

SEQ ID NO: 727 - DNA, 924 bp, Oryza sativa
  G3385
atggggcggccgccgtgttgcgagaaggagggggtgaagaaggggccatggacgccggaggaggacatggtgctggcgtcgtacgtgcaggagcacggcccgggcaactggcgcgccgtgccgcccaggacgggcctcctccgctgcagcaagagctgccgcctccgctggaccaactacctccgcccgggcatccgccgcggcggcttctcccaccacgaggagcgcctcatcctccacctccaggccctcctcggcaaccgctgggccgccatcgcctcctacctcccccaccgcaccgacaacgacgtcaagaacttctggaacacccacctcaagaagaagctcgccctcacctcctcctcctcctcgccgccgacgccgacgacgccgctcgtcgccagggggcagtgggagcgcaagctgcagaccgacatcgacctcgccaggcgcgccctccgcgacgccctctccgtcgacgacgccgcctccccggcgatgatcagcagcgggccgcccgcgccggcggcggcggcggcgtacgccctgagcgagcgcaacatctccgtgatgctgagcggctgggcggcgccgcctccggccaggaaaggattgtcagcctgcaacccggcggcggcgacgacgacgcccggtggcgccgccgcggagagcgcgtccacggccgggacgtcgttggagctcaccgccgactgctgctccggcggcggcgactccagcgcgtccaactgcctgccgtcgtccatgctcctcgcgtgcgacgacggcgacgcgacggcgacggcggccggggtggcgccgctgtcggcgatcgagtcgtggctgctgctcgacgacagcggagagccgcagctggcactggacgagcagctgctggacgtagctctccgtaattacgctttctaa

SEQ ID NO: 728 - protein, 307 aa, Oryza sativa
  G3385
MGRPPCCEKEGVKKGPWTPEEDMVLASYVQEHGPGNWRAVPPRTGLLRCSKSCRLRWTNYLRPGIRRGGFSHHEERLILHLQALLGNRWAAIASYLPHRTDNDVKNFWNTHLKKKLALTSSSSSPPTPTTPLVARGQWERKLQTDIDLARRALRDALSVDDAASPAMISSGPPAPAAAAAYALSERNISVMLSGWAAPPPARKGLSACNPAAATTTPGGAAAESASTAGTSLELTADCCSGGGDSSASNCLPSSMLLACDDGDATATAAGVAPLSAIESWLLLDDSGEPQLALDEQLLDVALRNYAF

SEQ ID NO: 729 - DNA, 1026 bp, Oryza sativa
  G3386
atggtgaggccgccgtgctgcgacaaggacggcgtcaagaagggcccgtggacgccggaggaggacctcgtcctcgtctcctacgtccaggagcacggccccggcaactggcgcgccgtcccgaccagaacagggctgatgcggtgcagcaagagctgtaggctccggtggaccaactacctgaggcccgggatcaagcggggaaacttcaccgaccaggaggagaagctcatcgtccacctccaggcgctcctcggcaaccgctgggcggccatcgcgtcgtacctccccgagcgcacggacaacgacatcaagaactactggaacacccacctcaagcgcaagctgcagggcggcggcgccggcggtgacggagacggtggcgccgccggcgacgcggtctccccgaagcccgccgcgcagaggcccgcgtcgtcgtccaaggggcagtgggagcggcgcctgcagaccgacatcgacatggcgcgccgcgcgctccgcgaggcgctcacgtcgctcgacgacgtcaagccaccgcatcagcccgacgccgccaacgccgccgcggggggaggcggcgccaccaccggagcagcagcgtccgccggcgccgatagccccgccgcgtcgagcacgtcgggggcgtcgcagtgctccccgtcatccgccggctacgtcctcaccaccgagaacatctcccggatgctcgacgggtgggcccggaagaagggcggcggcggcggcaggcgcgccgccggcagcgggccggccacccccggcgccaccgagagcgcgtccggctcgtcggaagcctccgaggtgtcctacggcggcacggccttgtccgcagcggcggcgcccgcgtccgccttcgagtacgagacaaagccgaccgtcaccgccgccgccgccgccgacgccggcgacgagacgcagctctccgccatcgagtcgtggctgttcgccgacgccgacggcatcgagagtggcagcttgctcgacgcggccatggattacaccttctaa

SEQ ID NO: 730 - protein, 341 aa, Oryza sativa
  G3386
MVRPPCCDKDGVKKGPWTPEEDLVLVSYVQEHGPGNWRAVPTRTGLMRCSKSCRLRWTNYLRPGIKRGNFTDQEEKLIVHLQALLGNRWAAIASYLPERTDNDIKNYWNTHLKRKLQGGGAGGDGDGGAAGDAVSPKPAAQRPASSSKGQWERRLQTDIDMARRALREALTSLDDVKPPHQPDAANAAAGGGGATTGAAASAGADSPAASSTSGASQCSPSSAGYVLTTENISRMLDGWARKKGGGGGRRAAGSGPATPGATESASGSSEASEVSYGGTALSAAAAPASAFEYETKPTVTAAAAADAGDETQLSAIESWLFADADGIESGSLLDAAMDYTF

SEQ ID NO: 731 - DNA, 1291 bp, Oryza sativa
  G3388
ctagacactgccctaattacaacccatttgcttatctctctcctctctctctctctctcgctgcagccatagcttagctagagctagagctttcttggtgccgagatgggggtggtcagcttctcctcgacttcctccggcgcgtccacggccaccaccgagtccggcggcgccgtgcggatgtcgccggagccggtggtggcggtggcggcggcggctcaacagctaccggtggtgaagggagttgactcggcggatgaggtggtgacgtcgaggccggcggcggcggcggcgcagcagtcgtcgcggtacaagggggtggtgccgcagccgaacgggaggtggggggcgcagatctacgagcggcacgcgcgggtgtggctcgggacgttccccgacgaggaggcggcggcgcgggcctacgacgtggcggcgctccggtaccgggggcgcgacgcggccaccaacttccccggggccgcggcgtcggccgccgagctcgcgttcctcgccgcgcactccaaggccgagatcgtcgacatgctccggaagcacacctacgccgacgagctccgccaggggctccgccgcggccgcggcatgggcgcccgcgcccagcccacgccgtcgtgggcgcgcgagccgctgttcgagaaggccgtgacgcccagcgacgtcggcaagctcaaccgcctcgtggtgcccaagcagcacgccgagaagcacttcccgctccgccgcgcggcgagctccgactccgcctccgccgccgccaccggcaagggcgtgctcctcaacttcgaggacggcgaggggaaggtgtggcgattccggtactcgtactggaacagcagccagagctacgtgctgaccaaggggtggagccgattcgtgagggagaagggcctccgcgccggcgacaccatagtcttctcccgctcggcgtacggccccgacaagctgctcttcatcgactgcaagaagaacaacgcggcggcggcgaccaccacctgcgccggcgacgagaggccaaccacaagcggcgccgaaccacgcgtcgtgaggctcttcggcgtcgacatcgccggcggcgattgccggaagcgggagagggcggtggagatggggcaagaggtcttcctactgaagaggcaatgcgtggttcatcagcgtactcctgccctaggtgccctgctgttatagcatcaaatcaaattcatatatagatcaaatcaaatcttcttctcttccatcttttttgttgttcatcgtctgttgtttcatcttcgag

SEQ ID NO: 732 - protein, 365 aa, Oryza sativa
  G3388
MGVVSFSSTSSGASTATTESGGAVRMSPEPVVAVAAAAQQLPVVKGVDSADEVVTSRPAAAAAQQSSRYKGVVPQPNGRWGAQIYERHARVWLGTFPDEEAAARAYDVAALRYRGRDAATNFPGAAASAAELAFLAAHSKAEIVDMLRKHTYADELRQGLRRGRGMGARAQPTPSWAREPLFEKAVTPSDVGKLNRLVVPKQHAEKHFPLRRAASSDSASAAATGKGVLLNFEDGEGKVWRFRYSYWNSSQSYVLTKGWSRFVREKGLRAGDTIVFSRSAYGPDKLLFIDCKKNNAAAATTTCAGDERPTTSGAEPRVVRLFGVDIAGGDCRKRERAVEMGQEVFLLKRQCVVHQRTPALGALLL

SEQ ID NO: 733 - DNA, 1068 bp, Oryza sativa
  G3389
gctaggctgttctctctttccattcgtcaagaactaccacgacgtcgacatcataatcgtcagagagctcgagaaattttttagtatctttgatccagatcgatcatggagcaagaagctgccatggtcgtcttctcctgcaactccggctccggtgggtcgtcgtcgacgaccgattcaaagcaagaggaggaggaggaggaggagttggccgcaatggaggaagacgagttgatccacgtcgtccaggcggcggagctgcggctgccgtcgtcgacgacggcgacgcggccgtcgtcgcggtacaagggggtggtgccgcagccgaacgggcggtggggggcgcagatctacgagcggcacgcgcgggtgtggctcgggacgttccccgacgaggaggcggcggcgcgcgcctacgacgtggcggcgctccgcttccgggggcgcgacgccgtcaccaaccgcgccccggcggcggagggcgcgtccgccggcgagctcgcgttcctggccgcgcactccaaggcggaggtcgtggacatgctgcggaagcacacctacgacgacgagctccagcagggcctccgccgcggctcgcgcgcgcagccgacgccgcggtgggcgcgcgagccgctgttcgagaaggccgtgacgccgagcgacgtcggcaagctcaaccgcctcgtggtgcccaagcagcaggccgagaggcatttcccgttcccgctccgccgccacagctccgacgccgccggcaagggcgtgctcctcaacttcgaggacggcgacggcaaggtgtggcgattccggtactcgtactggaacagcagccagagttacgtgctcaccaaggggtggagccgattcgtgagggagaagggcctccgaccaggcgacaccgtggccttctcccggtcggcggcggcgtgggggacggagaagcacctcctcatcgactgcaagaagatggagaggaacaacctggcaaccgtcgacgacgatgcccgtgtcgtcgtcaagctgttcggcgttgacatcgccggagacaagacgaggtaacacgcaagc

SEQ ID NO: 734 - protein, 317 aa, Oryza sativa
  G3389
MEQEAAMVVFSCNSGSGGSSSTTDSKQEEEEEEELAAMEEDELIHVVQAAELRLPSSTTATRPSSRYKGVVPQPNGRWGAQIYERHARVWLGTFPDEEAAARAYDVAALRFRGRDAVTNRAPAAEGASAGELAFLAAHSKAEVVDMLRKHTYDDELQQGLRRGSRAQPTPRWAREPLFEKAVTPSDVGKLNRLVVPKQQAERHFPFPLRRHSSDAAGKGVLLNFEDGDGKVWRFRYSYWNSSQSYVLTKGWSRFVREKGLRPGDTVAFSRSAAAWGTEKHLLIDCKKMERNNLATVDDDARVVVKLFGVDIAGDKTR

SEQ ID NO: 735 - DNA, 1348 bp, Oryza sativa
  G3390
cttcagaggcttcacctttcatcagcttagctagctagctgctcgatccggcggcgtgatcgatcgatctctctgattctatcaggtgttcgaccagattccatcgatggacagcacgagctgtctcttggacgacgcgagcagcggcgcgtccacgggcaagaaggcggcggcggcggcggcgtcgaaggcgctgcagcgcgtgggcagcggcgccagcgcggtgatggacgcggccgagcctggcgccgaggcggactcgggcggcgagcggcgcggcggcggcggcgggaagctgccgtcgtccaagtacaagggcgtggtgccgcaaccgaacgggcggtggggcgcgcagatatacgagcggcaccagcgggtgtggctcggcacgttcaccggcgaggcggaggcggcgcgcgcctacgacgtggcggcgcagcggttccgcggccgcgacgccgtcaccaacttccgcccgctcgccgagtccgacccggaggccgccgtcgagctccgcttcctcgcgtcccgctccaaggccgaggtcgtcgacatgctccgcaagcacacctacctcgaggagctcacgcagaacaagcgcgccttcgccgccatctccccgccgccccccaagcaccccgcctcctctccgacgtcctcctccgccgcgcgcgagcacctgttcgacaagacggtgacgcccagcgacgtcgggaagctgaaccggctggtgatccccaagcagcacgccgagaagcacttcccgctccagctccctccccctaccacaacctcctccgtcgccgccgccgccgacgccgccgccggcggcggcgattgcaagggcgtcctcctcaacttcgaggacgccgccgggaaggtgtggaaattccggtactcctactggaacagcagccagagctacgtgctcaccaaggggtggagccgcttcgtcaaggagaaggggctccacgccggcgacgccgtcggcttctaccgcgccgccggtaagaacgcgcagctcttcatcgactgcaaggtccgggcaaaacccaccaccgccgccgccgccgccgccttcctcagcgcggtggccgccgccgccgcgccgccacccgccgtgaaggctatcaggctgttcggtgtcgacctgctcacggcggcggcgccggagctgcaggacgccggcggcgccgccatgaccaagagcaagagagccatggacgccatggctgagtcacaagcacacgtggtttttaagaagcaatgcatagagcttgcgctaacctagctagcacgctgatgcagctagcgttttttttgctcattcgcttgcttgcttaattat

SEQ ID NO: 736 - protein, 394 aa, Oryza sativa
  G3390
MDSTSCLLDDASSGASTGKKAAAAAASKALQRVGSGASAVMDAAEPGAEADSGGERRGGGGGKLPSSKYKGVVPQPNGRWGAQIYERHQRVWLGTFTGEAEAARAYDVAAQRFRGRDAVTNFRPLAESDPEAAVELRFLASRSKAEVVDMLRKHTYLEELTQNKRAFAAISPPPPKHPASSPTSSSAAREHLFDKTVTPSDVGKLNRLVIPKQHAEKHFPLQLPPPTTTSSVAAAADAAAGGGDCKGVLLNFEDAAGKVWKFRYSYWNSSQSYVLTKGWSRFVKEKGLHAGDAVGFYRAAGKNAQLFIDCKVRAKPTTAAAAAAFLSAVAAAAAPPPAVKAIRLFGVDLLTAAAPELQDAGGAAMTKSKRAMDAMAESQAHVVFKKQCIELALT

SEQ ID NO: 737 - DNA, 1338 bp, Oryza sativa
  G3391
ggagagtaggagtgtgctagtgtgtgaggtctactgaaatggacagctccagctgcctggtggatgataccaacagcggcggctcgtccacggacaagctgagggcgttggccgccgcggcggcggagacggcgccgctggagcgcatggggagcggggcgagcgcggtggtggacgcggccgagcctggcgcggaggcggactccgggtccgggggacgtgtgtgcggcggcggcggcggcggtgccggcggtgcgggagggaagctgccgtcgtccaagttcaagggcgtcgtgccgcagcccaacgggaggtggggcgcgcagatctacgagcggcaccagcgggtgtggctcggcacgttcgccggggaggacgacgccgcgcgcgcctacgacgtcgccgcgcagcgcttccgcggccgcgacgccgtcaccaacttccgcccgctcgccgaggccgacccggacgccgccgccgagcttcgcttcctcgccacgcgctccaaggccgaggtcgtcgacatgctccgcaagcacacctacttcgacgagctcgcgcagagcaagcgcaccttcgccgcctccacgccgtcggccgcgaccaccaccgcctccctctccaacggccacctctcgtcgccccgctcccccttcgcgcccgccgcggcgcgcgaccacctgttcgacaagacggtcaccccgagcgacgtgggcaagctgaacaggctcgtcataccgaagcagcacgccgagaagcacttcccgctacagctcccgtccgccggcggcgagagcaagggtgtcctcctcaacttcgaggacgccgccggcaaggtgtggcggttccggtactcgtactggaacagcagccagagctacgtgctaaccaagggctggagccgcttcgtcaaggagaagggtctccacgccgacggcaagctcttcatcgactgcaagttagtacggtcgaccggcgccgccctcgcgtcgcccgctgatcagccagcgccgtcgccggtgaaggccgtcaggctcttcggcgtggacctgctcacggcgccggcgccggtcgaacagatggccgggtgcaagagagccagggacttggcggcgacgacgcctccacaagcggcggcgttcaagaagcaatgcatagagctggcactagtatagagttagcactattagctcgatcttctctagctagtgtcttttttgctcccatgcatcataattcaggtggtagctagcttagtcccttgttgatcctatctactaatctcacttggttttttttgttaatttattcgcccatgttcttgcttgctttgctgta

SEQ ID NO: 738 - protein, 378 aa, Oryza sativa
  G3391
MDSSSCLVDDTNSGGSSTDKLRALAAAAAETAPLERMGSGASAVVDAAEPGAEADSGSGGRVCGGGGGGAGGAGGKLPSSKFKGVVPQPNGRWGAQIYERHQRVWLGTFAGEDDAARAYDVAAQRFRGRDAVTNFRPLAEADPDAAAELRFLATRSKAEVVDMLRKHTYFDELAQSKRTFAASTPSAATTTASLSNGHLSSPRSPFAPAAARDHLFDKTVTPSDVGKLNRLVIPKQHAEKHFPLQLPSAGGESKGVLLNFEDAAGKVWRFRYSYWNSSQSYVLTKGWSRFVKEKGLHADGKLFIDCKLVRSTGAALASPADQPAPSPVKAVRLFGVDLLTAPAPVEQMAGCKRARDLAATTPPQAAAFKKQCIELALV

SEQ ID NO: 739 - DNA, 1290 bp, Zea mays
  G3432
ctatagctagcactagcagtggtgcacactgaaatggacagcgccagcagcctcgtggacgacaccagtagcggtggcggcggcggcgcgtccacggacaagctaagggctctggccgtcttcgccgccgcctcggggacgccgctggagcgcatgggcagcggcgccagcgcggtcgtggacgcggccgagccgggcgccgaggcggactccggttccggtgccgccgcggtgagcgtcggcgggaagctgccgtcgtcaaggtacaagggcgtggtgccgcagcccaacgggcggtggggcgcgcagatctacgagcgccaccagcgcgtgtggctcggcaccttcgcgggcgaggccgacgcggcgcgcgcctacgacgtcgcggcgcagcggttccgcggccgcgacgcggtcaccaacttccgcccgctcgcggacgccgacccggacgccgccgccgagctccggttcctggcgtcccgctccaaggccgaggtcgtcgacatgctccgcaagcacacctacttcgacgagctcgcgcagaacaagcgcgccttcgccgccgcgtccgcgtccgcggccaccgcctcgtcgctggccaacaacccttcttcctacgcgtcgctctcccccgcgaccgcgacggccgccgcgcgggagcacctcttcgacaagacggtcacccccagcgacgtgggcaagctgaaccggctggtgatcccgaagcagcacgccgagaagcacttcccgctgcagctcccatccgccggcggcgagagcaagggcgtgctcctcaacctggaggacgccgcgggcaaggtgtggcggttccgctactcgtactggaacagcagccagagctacgtgctcaccaagggctggagccgcttcgtcaaggagaagggcctccaagccggcgacgtcgtcggcttctaccgctccgctgccggcgccgacaccaagctcttcatcgactgcaagctgcggcccaacagcgtcgtcgtcgcctcgacggcaggcccgtcgcctccggcgccggtggcgaaggccgtgcgtctcttcggcgtcgacctgctgacggcaccggccaccgccgcggcgccggcggaggccgtggccgggtgcaagagagccagggacttgggttcgcccccgcaggcggcgttcaagaagcagctcgtggagctggcactagtgtagattaatgctacggagcgatcgatctttccctggctagctagtcttttttttttttgctcgatcgctcaactcagatggtagcatcat

SEQ ID NO: 740 - protein, 389 aa, Zea mays
  G3432
MDSASSLVDDTSSGGGGGASTDKLRALAVFAAASGTPLERMGSGASAVVDAAEPGAEADSGSGAAAVSVGGKLPSSRYKGVVPQPNGRWGAQIYERHQRVWLGTFAGEADAARAYDVAAQRFRGRDAVTNFRPLADADPDAAAELRFLASRSKAEVVDMLRKHTYFDELAQNKRAFAAASASAATASSLANNPSSYASLSPATATAAAREHLFDKTVTPSDVGKLNRLVIPKQHAEKHFPLQLPSAGGESKGVLLNLEDAAGKVWRFRYSYWNSSQSYVLTKGWSRFVKEKGLQAGDVVGFYRSAAGADTKLFIDCKLRPNSVVVASTAGPSPPAPVAKAVRLFGVDLLTAPATAAAPAEAVAGCKRARDLGSPPQAAFKKQLVELALV

SEQ ID NO: 741 - DNA, 1437 bp, Zea mays
  G3433
cccacgcgtccgcccacgcgtccgcgcaagcgcaacagaagcatactacgccgctacgcgctgggcggtgccgcacagctatagatagctagcagtgttgcatagaaatggacagcgccagcagcctcgtggacgacaccagcggcagcggcggcggcgcgtgcacggacaagctaagggctttggccgccgccgccgcctccgcctcggggccaccgccggagcgcatgggcagcggagccagcgcggtcgtggacgcggccgagccgggcgccgaggcggactccggctccgccccggcctccgtcgccgccgtcgcggcgggcgtgggcgggaagctgccgtcgtccaggtacaagggcgtggtgccgcagcccaacgggcggtggggcgcgcagatctacgagcgccacctgcgcgtgtggctcggcaccttcacgggcgaggccgaggccgcgcgcgcctacgacgtggccgcgcagcggttccgggggcgcgacgccgtcaccaacttccgcccgctcgcggagtcggacttggacccggacgccgccgccgagctccggttcctcgcgtcccggtccaaggccgaggtcgtcgacatgctccgcaagcacacctacggcgaggagctcgcgcagaacaggcgcgccttcgccgctgcggcggcgtccctggcctcgccgcagctgccgccggccaagaacactagcccggcggcggcgcgcgagcacatgttcgacaaggtgctgaccccgagcgacgtaggcaagctcaaccggctggtggtgccaaagcagcacgcggagcggttcttcccggcggccggcgccgggtcgacgcagctgtgcttccaggaccgcggcggggcgctgtggcagttccgctactcctactgggggagcagccagagctatgtcatgaccaaggggtggagccgcttcgtccgcgccgcacgacttgccgcgggggacaccgtcaccttctcccgcagcggcggcggccgatacttcatcgagtaccgccactgccagcgccggcgccgcgacgtcgatatcagcttcggcgacgctgccaccgtgccggcgtggccgaggccgatagttatcggaaccgcggccatgaataatgggggtgcaacggtggcgtccgccaccatcgccggccatgacatcgaggtggcagtggcaccctcgggggcgaggagcttcaggctcttcgggttcaatgttgagtgcagcggcgacgatgcaccggcaccggcacctgctcccgccgaagtggagtatgtcgacggcgacacctagtagcagcggcggcgtagagtgcgcagagagacgatgaacgatggtgatctactgatcagggaccttattacaccataggtggcgtgcatgccttgttgaatcttaattagtcatgtttttcgaaaaaaaa

SEQ ID NO: 742 - protein, 399 aa, Zea mays
  G3433
MDSASSLVDDTSGSGGGACTDKLRALAAAAASASGPPPERMGSGASAVVDAAEPGAEADSGSAPASVAAVAAGVGGKLPSSRYKGVVPQPNGRWGAQIYERHLRVWLGTFTGEAEAARAYDVAAQRFRGRDAVTNFRPLAESDLDPDAAAELRFLASRSKAEVVDMLRKHTYGEELAQNRRAFAAAAASLASPQLPPAKNTSPAAAREHMFDKVLTPSDVGKLNRLVVPKQHAERFFPAAGAGSTQLCFQDRGGALWQFRYSYWGSSQSYVMTKGWSRFVRAARLAAGDTVTFSRSGGGRYFIEYRHCQRRRRDVDISFGDAATVPAWPRPIVIGTAAMNNGGATVASATIAGHDIEVAVAPSGARSFRLFGFNVECSGDDAPAPAPAPAEVEYVDGDT

SEQ ID NO: 743 - DNA, 994 bp, Zea mays
  G3438
ccacgcgccccctcagctcaatcccgagacaaaggaacccacctccactcccaccagcaagctcaagcaagcagccaccaccagcagcgatcagcggcagccatggacatgggccggcaccagctccagctccagcacgcggcctcctcgtcctccacctcggcgtcgtcctcgtccgagcaggacaagccgctctgctgctctggtcccaagaagcgccccgcggggcgcaccaagttccgggagacgcggcacccggtgttccgcggcgtgcggcggcggggcgccgcggggcggtgggtgtgcgaggtgcgcgtccccgggcggcgcggcgcgcggctgtggctcggcacctacctcggcgccgaggcggcggcgcgcgcgcacgacgccgcgatgctcgccctgggccgcggcgcggcctgcctcaacttccccgactccgcgtggctgctcgccgtgccgcccccgcccgcgctctcgggcggcctggacggcgcccgccgggccgcgctcgaggccgtcgcggagttccagagacgccgcttcggggcggcagccgccgacgaagcgacctcgggcacgtctcctccctcctcctcctcctcggcgacgaagccggcgccggcgattgagcgcgtgcctgtggaggccagtgagacggtggcgttggacggcgccgtgttcgagcccgactggttcggggacatggacttggacttgtactatgccagcctcgcggaagggctgctcgtggagccgccgccgccgccaccgcccgccgcctgggatcatggtgactgctgcgactccggagctgacgtcgcgctctggagctactagcaagctatagcagcaataagctccaccaactcatctgtactgtagtgtacttgtaccttgtaccttgtaccaaaatccaaattgatttgtagcgaattaacttaccaatcccccttggcaactccaaaaaaaaaaaaaaaaaaaaaaaaag

SEQ ID NO: 744 - protein, 246 aa, Zea mays
  G3438
MDMGRHQLQLQHAASSSSTSASSSSEQDKPLCCSGPKKRPAGRTKFRETRHPVFRGVRRRGAAGRWVCEVRVPGRRGARLWLGTYLGAEAAARAHDAAMLALGRGAACLNFPDSAWLLAVPPPPALSGGLDGARRAALEAVAEFQRRRFGAAAADEATSGTSPPSSSSSATKPAPAIERVPVEASETVALDGAVFEPDWFGDMDLDLYYASLAEGLLVEPPPPPPPAAWDHGDCCDSGADVALWSY

SEQ ID NO: 745 - DNA, 1002 bp, Zea mays
  G3439
tcgcgatctagaactagtctcagctcaatcccgagacaaaggagccctcctccacctccactcccagcagcaagctcaagcaagcagccaccacaccaccagcagtgaacagcggcagccatggacatgggccggctccagctccagctccagcacgcggcctcctcgtcctccacctcggcgtcgtcctcgtcctcgtccgagcagaacaagctggcctggtccccgtcctccccgcagccgcccaagaagcgccccgcggggcgcaccaagttccgggagacgcggcacccggtgttccgcggcgtgcggcggcggggcgccgcgggccggtgggtgtgcgaggtgcgcgtccccgggcggcgcggcgcgcggctgtggctcggcacctacctcggcgccgaggcggcggcgcgcgcgcacgacgccgcgatgctcgccctgggccgcggcgccgcctgcctcaacttccccgactccgcgtggctgctcgccgtgccgcccccgcccgcgctctcgggcggcctggacggcgcccgccgggccgcgctcgaggccgtcgcggagttccagcgacgccgcttcggggcggtagccgccgacgaagcgacctcgggcacgtctcctccctcctcctcctcgtcgccgtcgggcacttatgtctcgcaggcgccggcgccggcgattgagcgcgtgcctgtggaggccagtgagacggcggcgttggacggcgccgtgttcgagcccgactggttccgggacatggacttggacttgtactatgccagcctcgcggaagggctgctcgtggagccgccgccaccgcccgccgcctgggatcatggtgactgctcccactccggagctgacgtcgcgctctggagctactagcaagctatagcagcaataagcttggcaatgccaccaactcatctgtactgtactgtacttgtaccctgtaccaaaatccaaattgatttccagcaaattaacttaccaatc

SEQ ID NO: 746 - protein, 256 aa, Zea mays
  G3439
MDMGRLQLQLQHAASSSSTSASSSSSSEQNKLAWSPSSPQPPKKRPAGRTKFRETRHPVFRGVRRRGAAGRWVCEVRVPGRRGARLWLGTYLGAEAAARAHDAAMLALGRGAACLNFPDSAWLLAVPPPPALSGGLDGARRAALEAVAEFQRRRFGAVAADEATSGTSPPSSSSSPSGTYVSQAPAPAIERVPVEASETAALDGAVFEPDWFRDMDLDLYYASLAEGLLVEPPPPPAAWDHGDCSHSGADVALWSY

SEQ ID NO: 747 - DNA, 976 bp, Zea mays
  G3440
cacgcgtccgctcgaacacaaactcaggcaaggcaaaaggaacccgcaccatccgaggctcaagcagggaagtgatcatcatcatcatcagaagaagatgtgcccaaccaagaaggggatgaccggagagccgagctcgccatgcagctcggcatcagcctcgaccttaccggagcaccaccagacggtgtggacgtcgccgccgaagcggccagcggggcggaccaagttccgggagacgcggcacccggtgttccgcggcgtccggcgccggggcagcgccgggcggtgggtgtgcgaggtgcgcgtgccggggaggcgcggctgcaggctctggctcggcaccttcgacacggccgaggcggcggcccgcgcgcacgacgccgccatgctcgccctcgccggcgcgggcgcctgctgcctcaacttcgccgactcggcctggctcctcgcggtcccggcctcgtgcgccagcctcgccgaggtccgccacgcggtcgcggacgccgtggacgacttcctccgccatcagctggtcccggaggacgacgccctcgcggccacgccgtcgtcgccttccagcgaagacggcaacacctctgatggcggggagtcctcctctgattcctctccgcccaccggggcctcgccgttcgaatttgatgtgttcaatgacatgagctgggacctgcactacgcgagcttggcgcagggattgctcgtggagccaccgtccgcggtcacggcgttcatggacgaaggcttcgccgatgtgccgctctggagctactagagactgaaattttccgtttctttgcttggcctgtggcgcctaattttggcagtgtaaaacggttacttcttttggtaatgagatggaacaagtttgcgaaacatgaaaacagagcatgctaatcgacattttcgcgcggccgaaaaaaaaaaaaaaaaaaaaaaaaaaaaaaaaaaaaaaaag

SEQ ID NO: 748 - protein, 231 aa, Zea mays
  G3440
MCPTKKGMTGEPSSPCSSASASTLPEHHQTVWTSPPKRPAGRTKFRETRHPVFRGVRRRGSAGRWVCEVRVPGRRGCRLWLGTFDTAEAAARAHDAAMLALAGAGACCLNFADSAWLLAVPASCASLAEVRHAVADAVDDFLRHQLVPEDDALAATPSSPSSEDGNTSDGGESSSDSSPPTGASPFEFDVFNDMSWDLHYASLAQGLLVEPPSAVTAFMDEGFADVPLWSY

SEQ ID NO: 749 - DNA, 798 bp, Zea mays
  G3441
cagccatcgcgttccgcatcgaaccagcacatcgcaagacaagcagcagcagccaccactgccatcacatggagtacgccgccgtcggctacggctacgggtacgggtacgacgagcgccaggagccggcggagtccgcggacggcggcggcggcggcgacgacgagtacgcgacggtgctgtcggcgccacccaagcggccggcggggcggaccaagttccgggagacgcggcaccccgtgtaccgcggcgtgcggcggcgcgggcccgcggggcgctgggtgtgcgaggtccgcgagcccaacaagaagtcgcgcatctggctcggcaccttcgccacccccgaggccgccgcgcgcgcgcacgacgtggccgcgctggccctgcggggccgcgccgcgtgcctcaacttcgccgactcggcgcgcctgctccaggtcgaccccgccacgctcgccacccccgacgacatccgccgcgccgccatccagctcgccgacgccgcctcgcagcaggatgagactgccgccgttgccgctgacgtggtcgcgccctcgcaggcggacgacgtcgccgccgccgccgccgccgcggcggcgatgtacggcggcggcatggagttcgaccactcgtattgctacgacgacgggatggtgagcgggagcagcgactgctggcaaagcggcgccggcgccggcggatggcatagcatcgtggacggcgacgacgacgacggcgccagcgacatgacgctctggagctactgagctgtagagtctgtctccagcgcaggaggtt

SEQ ID NO: 750 - protein, 232 aa, Zea mays
  G3441
MEYAAVGYGYGYGYDERQEPAESADGGGGGDDEYATVLSAPPKRPAGRTKFRETRHPVYRGVRRRGPAGRWVCEVREPNKKSRIWLGTFATPEAAARAHDVAALALRGRAACLNFADSARLLQVDPATLATPDDIRRAAIQLADAASQQDETAAVAADVVAPSQADDVAAAAAAAAAMYGGGMEFDHSYCYDDGMVSGSSDCWQSGAGAGGWHSIVDGDDDDGASDMTLWSY

SEQ ID NO: 751 - DNA, 1085 bp, Zea mays
  G3442
gctcaagctcgagacaagaaaccagaaccagctcactcctcactccacttccactcccaacagcaagctcaagcagtcagtcaccggcaggggtcagggtcacagtcacagcagcagccatggacacggccggcctcgtccagcacgcgacctcctcgtcttccacctccacctcggcgtcgtcgtcctcgtccgagcagcagagccgcaaggcggcgtggccgccgtcgaccgcttcctcaccacagcagccgcccaagaagcgccccgcggggcgcacaaagttccgggagacgcggcacccggtgttccgcggcgtgcggcggcggggcgccgcgggccggtgggtgtgcgaggtgcgcgtcccggggaggcgcggcgcgcggctgtggctcggcacctacctcgccgccgaggcggcggcgcgcgcgcacgacgccgcgatactcgccctgcagggccgcggcgcggggcgcctcaacttcccggactccgcgcggctgctcgccgtgccgcccccgtccgcgctcccgggcctggacgacgcccgccgcgcggcgctcgaggccgtcgcggagttccagcgccgctctgggtccgggtccggggccgccgacgaagcgacctcgggcgcgtctcctccctcctcgtcgccgtcgctgccggacgtttctgcggctggctcgccggcggcggcgcttgagcacgtgcctgtgaaggccgacgaagcagtggcgttggacttggacggcgacgtgttcgggcccgactggttcggggacatgggcctggagttggatgcgtactacgccagcctcgcggaagggttgctcgtggagccgccgccgccgccggcggcctgggatcatggagactgctgtgactccggagctgcggacgtcgcgctctggagctactactagcaaagttaacaataataagcttgacagccaaccccaaaagccccccaactgattgtattcacctctgtaacaaaattcaaattgatttcccagcaaatgaacttcaaaagaagtctttggttccgatttaaaaaaaaaaaaaaaaaaaaaaaaaaaaaaaaa

SEQ ID NO: 752 - protein, 267 aa, Zea mays
  G3442
MDTAGLVQHATSSSSTSTSASSSSSEQQSRKAAWPPSTASSPQQPPKKRPAGRTKFRETRHPVFRGVRRRGAAGRWVCEVRVPGRRGARLWLGTYLAAEAAARAHDAAILALQGRGAGRLNFPDSARLLAVPPPSALPGLDDARRAALEAVAEFQRRSGSGSGAADEATSGASPPSSSPSLPDVSAAGSPAAALEHVPVKADEAVALDLDGDVFGPDWFGDMGLELDAYYASLAEGLLVEPPPPPAAWDHGDCCDSGAADVALWSYY

SEQ ID NO: 753 - DNA, 1253 bp, Glycine max
  G3451
ctagaatccgtacaatctaatcaacataacaaaaatggatgcaattagttgcatggatgagagcaccaccactgagtcactctctataagtctttctccgacgtcatcgtcggagaaagcgaagccttcttcgatgattacatcgtcggagaaggtttctctgtccccgccgccgtcaaacagactatgccgtgttggaagcggcgcgagcgcagtcgtggatcctgatggcggcggcagcggcgctgaggtagagtcgcggaaactcccctcgtcgaagtacaagggcgtggtgccccagcccaacggccgctggggtgcgcagatttacgagaagcaccagcgcgtgtggcttggaacgttcaacgaggaagacgaggcggcgcgtgcgtacgacatcgccgcgcagcggttccgcggcaaggacgccgtcacgaacttcaagccgctcgccggcgccgacgacgacgacggagaatcggagtttctcaactcgcattccaaacccgagatcgtcgacatgctgcgaaagcacacgtacaatgacgagctggagcagagcaagcgcagccgcggcgtcgtccggcggcgaggctccgccgccgccggcaccgcaaactcaatttccggcgcgtgctttactaaggcacgtgagcagctattcgagaaggctgttacgccgagcgacgttgggaaattgaaccgtttggtgataccgaagcagcacgcggagaagcactttccgttacagagctctaacggcgttagcgcgacgacgatagcggcggtgacggcgacgccgacggcggcgaagggcgttttgttgaacttcgaagacgttggagggaaagtgtggcggtttcgttactcgtattggaacagtagccagagttacgtcttaaccaaaggttggagccggttcgttaaggagaagaatctgaaagctggtgacacggtttgttttcaccggtccactggaccggacaagcagctttacatcgattggaagacgaggaatgttgttaacaacgaggtcgcgttgttcggaccggtcggaccggttgtcgaaccgatccagatggttcggctctttggggttaacattttgaaactacccggttcagatactattgttggcaataacaataatgcaagtgggtgctgcaatggcaagagaagagaaatggaactgttctcgttagagtgtagcaagaaacctaagattattggtgctttgtaacgttacgttaggc

SEQ ID NO: 754 - protein, 401 aa, Glycine max
  G3451
MDAISCMDESTTTESLSISLSPTSSSEKAKPSSMITSSEKVSLSPPPSNRLCRVGSGASAVVDPDGGGSGAEVESRKLPSSKYKGVVPQPNGRWGAQIYEKHQRVWLGTFNEEDEAARAYDIAAQRFRGKDAVTNFKPLAGADDDDGESEFLNSHSKPEIVDMLRKHTYNDELEQSKRSRGVVRRRGSAAAGTANSISGACFTKAREQLFEKAVTPSDVGKLNRLVIPKQHAEKHFPLQSSNGVSATTIAAVTATPTAAKGVLLNFEDVGGKVWRFRYSYWNSSQSYVLTKGWSRFVKEKNLKAGDTVCFHRSTGPDKQLYIDWKTRNVVNNEVALFGPVGPVVEPIQMVRLFGVNILKLPGSDTIVGNNNNASGCCNGKRREMELFSLECSKKPKIIGAL

SEQ ID NO: 755 - DNA, 1081 bp, Glycine max
  G3452
caccaacacaaaatggatggaggctgtgtcacagacgaaaccaccacatccagcgactctctttccgttccgccgcccagccgcgtcggcagcgttgcaagcgccgtcgtcgaccccgacggttgttgcgtttccggcgaggccgaatcccggaaactcccttcgtcgaaatacaaaggcgtggtgccgcaaccgaacggtcgctggggagctcagatttacgagaagcaccagcgcgtgtggctcggcactttcaacgaggaagacgaagccgccagagcctacgacatcgccgcgctgcgcttccgcggccccgacgccgtcaccaacttcaagcctcccgccgcctccgacgacgccgagtccgagttcctcaactcgcattccaagttcgagatcgtcgacatgctccgcaagcacacctacgacgacgagctccagcagagcacgcgcggtggtaggcgccgcctcgacgctgacaccgcgtcgagcggtgtgttcgacgcgaaagcgcgtgagcagctgttcgagaaaacggttacgccgagcgacgtcgggaagctgaatcgattagtgataccgaagcagcacgcggagaagcactttccgttaagcggatccggcgacgaaagctcgccgtgcgtggcgggggcttcggcggcgaagggaatgttgttgaactttgaggacgttggagggaaagtgtggcggtttcgttactcttattggaacagtagccagagctacgtgcttaccaaaggatggagccggttcgttaaggagaagaatcttcgagccggtgacgcggttcagttcttcaagtcgaccggaccggaccggcagctatatatagactgcaaggcgaggagtggtgaggttaacaataatgctggcggtttgtttgttccgattggaccggtcgttgagccggttcagatggttcggcttttcggggtcaaccttttgaaactacccgtacccggttcggatggtgtagggaagagaaaagagatggaactgtttgcatttgaatgttgcaagaagttaaaagtaattggagctttgtaacattacatagtgc

SEQ ID NO: 756 - protein, 351 aa, Glycine max
  G3452
MDGGCVTDETTTSSDSLSVPPPSRVGSVASAVVDPDGCCVSGEAESRKLPSSKYKGVVPQPNGRWGAQIYEKHQRVWLGTFNEEDEAARAYDIAALRFRGPDAVTNFKPPAASDDAESEFLNSHSKFEIVDMLRKHTYDDELQQSTRGGRRRLDADTASSGVFDAKAREQLFEKTVTPSDVGKLNRLVIPKQHAEKHFPLSGSGDESSPCVAGASAAKGMLLNFEDVGGKVWRFRYSYWNSSQSYVLTKGWSRFVKEKNLRAGDAVQFFKSTGPDRQLYIDCKARSGEVNNNAGGLFVPIGPVVEPVQMVRLFGVNLLKLPVPGSDGVGKRKEMELFAFECCKKLKVIGAL

SEQ ID NO: 757 - DNA, 1442 bp, Glycine max
  G3453
acgagtatagctcttaaaatactcaacaataaccaaacctaatcaaaacccttatctacactcacttcacacaaaccaaagttagttcgttaaccgttacaaacacaaaatggatggaggcagtgtcacagacgaaaccaccacaaccagcaactctctttcggttccggcgaatctatctccgccgcctctcagccttgacggaagcggcgcaaccgccgtcgtctaccccgacggttgttgcgtctccggcgaagccgaatcccggaaactcccgtcctcgaaatacaaaggcgtggtgccgcaaccgaacggtcgttggggagctcagatttacgagaagcaccagcgcgtgtggctcggcaccttcaacgaggaagacgaagccgtcagagcctacgacatcgtcgcgcatcgcttccgcggccgcgacgccgtcactaacttcaagcctctcgccggcgccgacgacgccgaagccgagttcctcagcacgcattccaagtccgagatcgtcgacatgctccgcaggcacacctacgacaacgagctccagcagagcacccgcggcggcaggcgccgccgggacgccgaaaccgcgtcgagcggcgcgttcgacgcgaaggcgcgtgagcagctggtcgagaaaaccgttacgccgagcgacgtcgggaagctgaaccgattagtgataccaaagcagcacgcggagaagcactttccgttaagcggatccggcggcggagccttgccgtgcatggcggcggctgcgggggcgaaaggaatgttgctgaactttgaggacgttggagggaaagtgtggcggttccgttactcgtattggaacagtagccagagctacgtgcttaccaaaggatggagccggttcgttaaggagaagaatcttcgagctggtgacgcggttcagttcttcaagtcgaccggactggaccggcaactatatatagactgcaaggcgaggagtggtaaggttaacaataatgctgccggtttgtttattccggttggaccggttgttgagccggttcagatggtacggcttttcggggtcgaccttttgaaactacccgtacccggttcggatggtattggggttggctgtgacgggaagagaaaagagatggagctgtttgcatttgaatgtagcaagaagttaaaagtaattggagctttgtaacattacatagtttttgagtttcttttgttaattttgtaactgttgaattcgtgaggtagagatggtgatggcgttgttgttgcaagttgccactcacaaaacgtgtatattcttaatttgatgggaaaaaaaaggagaaattagggcaagaagaattgtataatgcaaaggtttttttcaaaagaaaggaacatggagtgccactatttatttttgtaaaaaaacagagaaaagggcggcccgc

SEQ ID NO: 758 - protein, 362 aa, Glycine max
  G3453
MDGGSVTDETTTTSNSLSVPANLSPPPLSLDGSGATAVVYPDGCCVSGEAESRKLPSSKYKGVVPQPNGRWGAQIYEKHQRVWLGTFNEEDEAVRAYDIVAHRFRGRDAVTNFKPLAGADDAEAEFLSTHSKSEIVDMLRRHTYDNELQQSTRGGRRRRDAETASSGAFDAKAREQLVEKTVTPSDVGKLNRLVIPKQHAEKHFPLSGSGGGALPCMAAAAGAKGMLLNFEDVGGKVWRFRYSYWNSSQSYVLTKGWSRFVKEKNLRAGDAVQFFKSTGLDRQLYIDCKARSGKVNNNAAGLFIPVGPVVEPVQMVRLFGVDLLKLPVPGSDGIGVGCDGKRKEMELFAFECSKKLKVIGAL

SEQ ID NO: 759 - DNA, 1188 bp, Glycine max
  G3454
atggatgcaattagttgcatggatgagagcaccaccaccgagtcactctccataagtcaggcgaagccttcttcgacgattatgtcgtccgagaaggcttctccttccccgccgccgccgaacaggctgtgccgcgtcggtagcggtgctagcgcagtcgtggattccgacggcggcggcgggggtggcagcaccgaggtggagtcgcggaagctcccctcgtccaagtataagggcgtcgtgccccagcccaacggccgctggggctcgcagatttacgagaagcaccagcgcgtgtggctgggaacgttcaacgaggaagacgaggcggcgcgtgcgtacgacgtcgccgtgcagcgattccgcggcaaggactccgtcacgaacttcaagccgctcgccggcgccgacgacgacgacggagaatcggagtttctcaactcgcattccaaacccgagatcgtcgacatgctgcgaaagcacacgtacaatgacgagctggagcatagcaagcgcaaccgcggcgtcgtccggcggcgaggctccgccgccgtcggcaccgcagactcaatttccggcgcgtgctttactaatgcacgtgagcagctattcgagaaagctgttacgccgagcgacgtttggaaattgaaccgtttggtgataccgaagcagcacgcggagaagcactttccgttacagagctctaacggcgttagcgcgacgacgatagcggcggtgacggcgacgccgacggcggcgaagggcgttttgttgaacttcgaagacgttggagggaaagtgtggcggtttcgttactcgtattggaacagtagccagagttacgtcttaaccaaaggttggagccggttcgttaaggagaagaatctgaaagctggtgacacggtttgttttcaccggtccactggaccggacaagcagctttacatcgattggaagacgaggaatgttgttaacaacgaggtcgcgttgttcggaccggtcggaccggttgtcgaaccgatccagatggttcggctctttggggttaacattttgaaactacccggttcagatactattgttggcaataacaataatgcaagtgggtgctgcaatggcaagagaagagaaatggaactgttctcgttagagtgtagcaagaaacctaagattattggtgctttgtaa

SEQ ID NO: 760 - protein, 395 aa, Glycine max
  G3454
MDAISCMDESTTTESLSISQAKPSSTIMSSEKASPSPPPPNRLCRVGSGASAVVDSDGGGGGGSTEVESRKLPSSKYKGVVPQPNGRWGSQIYEKHQRVWLGTFNEEDEAARAYDVAVQRFRGKDSVTNFKPLAGADDDDGESEFLNSHSKPEIVDMLRKHTYNDELEHSKRNRGVVRRRGSAAVGTADSISGACFTNAREQLFEKAVTPSDVWKLNRLVIPKQHAEKHFPLQSSNGVSATTIAAVTATPTAAKGVLLNFEDVGGKVWRFRYSYWNSSQSYVLTKGWSRFVKEKNLKAGDTVCFHRSTGPDKQLYIDWKTRNVVNNEVALFGPVGPVVEPIQMVRLFGVNILKLPGSDTIVGNNNNASGCCNGKRREMELFSLECSKKPKIIGAL

SEQ ID NO: 761 - DNA, 1014 bp, Glycine max
  G3463
caacaacactctcaacaaatgaatattctcggacaatcattcaacgaatcaaacaacggaagctactcttgttcgtcgccggagactggtagctcctctaacattccaaacacttttcactccgacgaggaagtgcacacactagcttcggcgcgtcctaagaaacgtgcggggcgtcgaatttttaaggagacaagacacccggtgtaccgaggagtacgaaggaggaacaacaacaagtgggtctgcgaggttcgtgttcccaacgacaagtccaccaggatttggcttggaacgtatccagtgcctgagatggccgcacgtgcgcacgacgtcgccgcgctcgcgcttcggggcaagtcggcttgcctcaacttcgccgactcggcgtggcggctgcccttgccggcgtcgacaaatgcgaaggagatacggcgagtggcggcggcggctgctgtagcgattgcggcggaagacagctgcggcgagcagttacagaatagtattgtgaatgatgccgttgctgatgattgtgaagttagcagaagtgacgtcagctttgatgaagattccaatagcaacaaaggtttgagagttttttgtgatttggatgaaattacaatggcagatgcaccggtttttgaggacatgcgtgagtggcttcagagtatggcggatgagcctttaagatcgcctacttttgtaacatatgttaatgttagggatgtctggaactttgtggaggatgatgctgaggtatccttgtggagcttcacaatttagtgcgtttagtttgttctttgtcttctttcgtttttggtttttgtacataattaggaacggaggagtacgaaaatgtaccaagaccgagacgatataaggagctagctatatagggaggatcataaaactgtaagacattgcaaattttctcattcagttgtttttgtaattctcataatcatatagataaaggaaaggtttgtaaaataaaaaaaaaaaaaaaaaaaaagg

SEQ ID NO: 762 - protein, 254 aa, Glycine max
  G3463
MNILGQSFNESNNGSYSCSSPETGSSSNIPNTFHSDEEVHTLASARPKKRAGRRIFKETRHPVYRGVRRRNNNKWVCEVRVPNDKSTRIWLGTYPVPEMAARAHDVAALALRGKSACLNFADSAWRLPLPASTNAKEIRRVAAAAAVAIAAEDSCGEQLQNSIVNDAVADDCEVSRSDVSFDEDSNSNKGLRVFCDLDEITMADAPVFEDMREWLQSMADEPLRSPTFVTYVNVRDVWNFVEDDAEVSLWSFTI

SEQ ID NO: 763 - DNA, 800 bp, Glycine max
  G3464
aattcggcaccaggttagttactactaactaccccttttgcacacgttgtctcattcactcaaacaacttcaaagaacgaagcttttcaccaagtaacatgttttccatcaatcatttctccgacccagatgccacctcgccggggtcgggaggaagctcccgaccggcgctgtcggacgaggatttttttctggcggcaagcaatcccaagaaacgcgccgggaggaagaagttccgggagacgcgccacccggtgtaccgcggcgtgagaaggcgggactccggcaagtgggtgtgcgaggtgcgcgagcccaacaagaagtccaggatttggctcgggacctttcccacggcggagatggcggcgcgtgcgcatgacgtggcggcgatcgcgctgaggggaaggtcagcctgcctcaacttcgccgactccgcgtctcggctcccggtgccggcgacggcggaggccagggacattcagaaggctgcggcggaggccgcagaggcgtttcgccctgggaaggatgatgatgcggtggcggagagggtggcagcgacggcgacggagcgtgaagaagaacaagaagaagggatggtgccggagtatctgaggaacatggtgctcatgtcgccgacgcattgcttcgggagtgatgagtatggaagtgctgacgtggaatttgacgatgctgaagtttctctgtggagttactccatttaatttaactcagttattggattttttttttactattttgagtaatgtaaagattgttcgtatgggacaagtagaatagtg

SEQ ID NO: 764 - protein, 207 aa, Glycine max
  G3464
MFSINHFSDPDATSPGSGGSSRPALSDEDFFLAASNPKKRAGRKKFRETRHPVYRGVRRRDSGKWVCEVREPNKKSRIWLGTFPTAEMAARAHDVAAIALRGRSACLNFADSASRLPVPATAEARDIQKAAAEAAEAFRPGKDDDAVAERVAATATEREEEQEEGMVPEYLRNMVLMSPTHCFGSDEYGSADVEFDDAEVSLWSYSI

SEQ ID NO: 765 - DNA, 1252 bp, Glycine max
  G3465
ctcgacccactcactctatctcttttctccagcagcaccaaaaccacccaacactcgaactcaatatccattattaccaaaaaaaaagaaaaaaggatatcaaacacccttttcatcattaaaactctcagttccctctttccctatcaaaaccctttcccacaacactactcactccagtacaagaaaccctttttcaatttggtttcaacagcacacacacacacacatatatatatatatagcatgtttaccttgaatcattcttctgatttgtaccatgtttcccctgagctctcatcttccttggacacatcctcgccggcttcggagggctctcgtggcgtggcattttccgacgaggaggtgcggctggcggtgaggcacccgaagaagcgggcaggtcggaagaagttccgggagacgcgccacccggtgtaccggggggtgaggaggaggaactcggataagtgggtgtgtgaggtgagggagcccaacaagaagaccaggatttggctggggactttccccacgccggagatggcggctcgggcgcacgacgtggcggcaatggccctgaggggccggtatgcctgtctaaactttgctgactcggcctggcggttacctgttcccgccacggccgaggcaaaggatatacagaaggcagcagcagaagctgcccaggctttcagaccagatcaaaccttaaaaaatgctaatacaaggcaggagtgtgtggaggcggtggcggtggcggtggcggagacaacaacggcgacggcacaaggggtgttttatatggaggaagaagagcaggtgttggatatgcctgagttgcttaggaatatggtgctcatgtccccaacacattgcttagggtatgagtatgaagatgctgacttggatgcccaagatgctgaggtgtcactatggaatttctcaatttaataatgtgttttggtttggtttttgttgttagttttttggagtgaacagtgtctgtactggttttttattagtagtacggatactagttataggtggaaagattgcgagggaccaaaaggaattttcttttgaacccttttttgtcaatgtaatcaatatcacgtatatcatgaagtgaatcccttcaagtttatgtataaattaaataaaagaaaaatctagttttggttatgaatctttgttaaagtagaaatcgttctttggagagtctgcaggccaatgtgcataggctcaaaacagg

SEQ ID NO: 766 - protein, 234 aa, Glycine max
  G3465
MFTLNHSSDLYHVSPELSSSLDTSSPASEGSRGVAFSDEEVRLAVRHPKKRAGRKKFRETRHPVYRGVRRRNSDKWVCEVREPNKKTRIWLGTFPTPEMAARAHDVAAMALRGRYACLNFADSAWRLPVPATAEAKDIQKAAAEAAQAFRPDQTLKNANTRQECVEAVAVAVAETTTATAQGVFYMEEEEQVLDMPELLRNMVLMSPTHCLGYEYEDADLDAQDAEVSLWNFSI

SEQ ID NO: 767 - DNA, 1162 bp, Glycine max
  G3466
ccctcattcactctcttttctccggcagcaccaaaaccacccaacacttgaaatcaatatccattgttaccaaaaaagaaaagatcaaaacaccctttacatcattatactcagttccctctttccctatcaaaaccctttcccacaacactactcactctagtagtacaagcaaaaccttctaactttggcttcagcggcacatatatatatatatatgaacatgtataccttgaaccactcttcatatttgtaccatgtttcccctgagctctcctcttccttggactcgtcctcgccggcttccgagggctctcgcggcgtggcattttccgacgaggaggtgcggctggcggtgaggcacccgaagaagcgggccgggcggaagaagttccgggagacgcgccacccggtgtaccggggcgtgaggaggaggaacacggataagtgggtaagtgaggtgagggagcccaacaaaaagaccaggatttggctggggacttttcccacgccggagatggcggcacgggcccacgacgtggcggcaatggccctgaggggccggtatgcctgtctcaacttcgctgactcgacgtggcggttaccaattcccgccactgctaacgcaaaggatatacagaaagcagcagcagaggctgccgaggctttcagaccaagtcagaccttagaaaatacgaatacaaagcaagagtgtgtaaaagtggtgacgacaacaacgatcacagaacaaaaacgaggaatgttttatacggaggaagaagagcaagtgttagatatgcctgagttgcttaggaatatggtgcttatgtccccaacacattgcatagggtatgagtatgaagatgctgacttggatgctcaagatgctgaggtgtccctatggagtttctcaatttaataacgtgcttttggtttggttttttatgttagttttggagtgtgactgtctgtactggttttttattagtagtacggatactagctataggtggcagattgaaagggaccaaaaggaattttcttttgaaaccctttttgtcaaagtaatcaatcgcgtatcatcaagtgaatcccttgatcaagtttatgtatgaattaaataaaagaagaatctagttttggtaaaaaaaaaaaaaaaagg

SEQ ID NO: 768 - protein, 233 aa, Glycine max
  G3466
MNMYTLNHSSYLYHVSPELSSSLDSSSPASEGSRGVAFSDEEVRLAVRHPKKRAGRKKFRETRHPVYRGVRRRNTDKWVSEVREPNKKTRIWLGTFPTPEMAARAHDVAAMALRGRYACLNFADSTWRLPIPATANAKDIQKAAAEAAEAFRPSQTLENTNTKQECVKVVTTTTITEQKRGMFYTEEEEQVLDMPELLRNMVLMSPTHCIGYEYEDADLDAQDAEVSLWSFSI

SEQ ID NO: 769 - DNA, 974 bp, Glycine max
  G3467
attcggctccggaaactccaaatacctcactccacagttgaacaacaacaccaacaccaacttctggaatgaacattttcaaatccccactggaccatgatttgaactgtggtggaatattccacgactcagcagaagcatcttattcgtctgaaacaaggagcaccccctcagacgaagaagtgattctagcgtcagcgcggccaaagaagcgagcgggaagaagagtcttcaaggagacaaggcaccccgtctaccgaggagtgcgtcgcaggaacaagaacaagtgggtctgcgagatgcgagtccccaacaacaactcacggatttggctcgggacatacccaacgcccgaaatggccgcacgtgcgcacgacgttgcggcgctcgcgctcaggggaaagtccgcgtgcctcaacttcgcggactccaggtggcggctgacggtgccggcgaccaccaacgcggaggagatacggcgagcggcgggggaggctgctgaggcatttgcagttgcagatggggacgacgttaatattgaacaacagcagagtgtgatggccacgaatgatgatgaagttcaagagcctctccagcaggaggaggttcaagacttgcatgatttgcttttgagtattgcgaatgagcctttgatgtctcctccaccctgtgcaagagatggtagggactggaatgacgtggacatatttgatgatgatgaaatctcactatggaacttctcaatttgacgcgtacgtcattaagagtatgactgtatgcatgtttgatgataagcgaaaacacctttttgtgtatgtgattttctatatttttagggacctgttgtgtgtagataaattaagtagcactcgattgattaagttgagtggagttaaacatattgtagttgtatctatgatttgtttcgtgattaaattttaatgacaagtacagttggcaaattcaaaaaaaaa

SEQ ID NO: 770 - protein, 226 aa, Glycine max
  G3467
MNIFKSPLDHDLNCGGIFHDSAEASYSSETRSTPSDEEVILASARPKKRAGRRVFKETRHPVYRGVRRRNKNKWVCEMRVPNNNSRIWLGTYPTPEMAARAHDVAALALRGKSACLNFADSRWRLTVPATTNAEEIRRAAGEAAEAFAVADGDDVNIEQQQSVMATNDDEVQEPLQQEEVQDLHDLLLSIANEPLMSPPPCARDGRDWNDVDIFDDDEISLWNFSI

SEQ ID NO: 771 - DNA, 1147 bp, Glycine max
  G3468
tcgactcgagccgaatcggctcgagccacaactcaactaagcgcaaaccaaaccaacacaaacaaaaacatctctcagcaaatgaatattctcggacaatcactccaccaatcaaacaacggcagctactcttgttcgtcgccggagactgcaaactcctctaaccttccgaccactccgaaagccgttcactccgacgaggaagtgaacacattagcatcggctcatcctaagaaacgtgcggggcgtcgaatttttaaggagacaaggcatcccgtgtacagaggagtgcggcggaggaacaacaacaagtgggtctgcgaggttcgtgttcccaacgacaagtccacgaggatttggctcggaacgtatccaacgcctgagatggccgcacgtgcgcacgacgtcgccgcgctctcgcttcgaggtaagtcggcgtgtctcaacttcgccgactcggcgtggcggttgcccttgccggcgtcgaccaatgcgaaggagattcggcgcgtggcggcggcggctgctgtagcgattgcggcggaagacagccgcggcaagcagttgcggactaatgcgattgatgccgttgctgattgcgaagttagcagcagtgacataggcgtcgatgaaaattgcaataacaataaagcttcgcagaggttttgtgatttggatgaaattacaatgccagatgcaccggtttttgaggacatgcatgagtggcttcagactatggctgctgaaccattaagatcacctacttttgtaacatatgttaatgttagggatgtctggaactttgtggaggatgatgctgaggtttccttgtggagcttcaccgtctgaagagcatgcaatttaggctttaggtgtatttagtgtgtttagctttctttctcttcttttggtttttgtacataattaggaacggaggactacgaaaatgtacaaagaccgaaacgatataaggagatagctatctaggtaggaacataaaagtgtgaaacattgtaacttttctcattcggttgtttttgtaaaataaaaattctattttcatcaatacattatcaaagaccctccctgttagcaatcctccaaaaaaaagagagagaaaaaaaaaaaaaaaaaaaaaaaaaaaagg

SEQ ID NO: 772 - protein, 255 aa, Glycine max
  G3468
MNILGQSLHQSNNGSYSCSSPETANSSNLPTTPKAVHSDEEVNTLASAHPKKRAGRRIFKETRHPVYRGVRRRNNNKWVCEVRVPNDKSTRIWLGTYPTPEMAARAHDVAALSLRGKSACLNFADSAWRLPLPASTNAKEIRRVAAAAAVAIAAEDSRGKQLRTNAIDAVADCEVSSSDIGVDENCNNNKASQRFCDLDEITMPDAPVFEDMHEWLQTMAAEPLRSPTFVTYVNVRDVWNFVEDDAEVSLWSFTV

SEQ ID NO: 773 - DNA, 883 bp, Glycine max
  G3469
attcggctcgagtgggatttttagtccattgaattggatatatttatcctcatacatgatcttaggagacatttgtttttggtaaccactcgtcccaagcctaaataagttaaaacacagaagaaaatgcagaagcggagggcagggaggaagaagttccacgagacacgacacccggtgtacaagggagtgaggcagaggaacgggaagtgggtaagcgagctgcgacaacctaacaacaaaaacgcgcgggtgtggctcggaacattcgcgcaccccgacatggctgctatagcgtacgatgttgccgccttggctttcaagggcgacagtgcttccttaaacttcccgaacgccgccacctcgtttccccgccttaactcgcggacgtgttccgttagggccattcagtttgcggcgacgcaggcggcggagaagcatttttcttgtgtagagtctcaacaactccaaagggagggatcaggctccggaagcttctctttggacgatgattcttcggagttttcgtcccaaggaaggttcttttgggatgaagaggaagtgtttaacatgccggagttgctgaactgcatggcggaagcgctgattatcacaccgccggcgttggaaagagggttcaattgggttggtggcgaaacgactgtggatttgactctgtggtgaaactgatgaccacttaggttctctgcaaaccagagaggaacttgcaatttcgatctgttgcaaaatattatatatactaatagtctaaagatgtagttcatcatatatactagtactgatacattcaaaagttatatagcgtttgctgtatggttgagattttcgtcaaaaacaagctgtatcataaatcttttctgtt

SEQ ID NO: 774 - protein, 185 aa, Glycine max
  G3469
MQKRRAGRKKFHETRHPVYKGVRQRNGKWVSELRQPNNKNARVWLGTFAHPDMAAIAYDVAALAFKGDSASLNFPNAATSFPRLNSRTCSVRAIQFAATQAAEKHFSCVESQQLQREGSGSGSFSLDDDSSEFSSQGRFFWDEEEVFNMPELLNCMAEALIITPPALERGFNWVGGETTVDLTLW

SEQ ID NO: 775 - DNA, 859 bp, Medicago sativa
  G3497
tctttccttcaaaaccaagtatgcttccctatatatataacgcaccttactcttcattctcttaaatcaaactctctctccaattcccactttccctcccaaaacaattttccactctctccaacacatacatatgttgactactaacaactcttccaattcacaatccatttcctcaacagcatcttcttcgtacgacatgtcaactccgaatttggaggtacgattagccgctagtaatccaaagaagcgagcagggaggaagatattcaaggaaactcgccacccggtgtatagaggtgtgaggaagagaaacttagataaatgggtgtgtgaaatgagggagcccaacacgaagactaggatttggctagggacttttccaaccgccgagatggcagcccaagctcacgatgttgcagccatggcattgaggggccgctacgcctgtgtcaattttgcagactcggtgtggcgccttcctattccagcaacctccaagataaaagatattcaaaaggctgctgctgaagctgcagaagcttttagaccagacaagactttaatgactaacgatattgacacggttgtagctgttgtcgccacaaaggagttgaatatgttttgtgtggaagtcgaagatgacgtgttgaatatgccagagttgtggaggaatatggcactaatgtctcgtacacatagctttgggtatgatgatcagtatgaagatattcatgtacaagactttcaagatgatgaggtatcactatggaacttctaaattttgtgtttggtttaattttatttttggattgtagaataggaaatgtctatactacaacctttttaattggtagca

SEQ ID NO: 776 - protein, 215 aa, Medicago sativa
  G3497
MLTTNNSSNSQSISSTASSSYDMSTPNLEVRLAASNPKKRAGRKIFKETRHPVYRGVRKRNLDKWVCEMREPNTKTRIWLGTFPTAEMAAQAHDVAAMALRGRYACVNFADSVWRLPIPATSKIKDIQKAAAEAAEAFRPDKTLMTNDIDTVVAVVATKELNMFCVEVEDDVLNMPELWRNMALMSRTHSFGYDDQYEDIHVQDFQDDEVSLWNF

SEQ ID NO: 777 - DNA, 851 bp, Medicago sativa
  G3498
tctttccttcaaaaccaagtatgcttccctatatatgtatataatccaacttactcttcattctcctaactctctccaattcccacttttcctcttaaaacaattttccactctctacacatacatatgtttactactaacaactcttcctattcacactccatttcctcaaaagcatcttcttcctactataactcattaccggattcggagatacgattagcggctagtaacccgaagaagagagcagggaggaagatattcaaggaaactcgccacccggtgtatagaggtgttaggaagaggaacttagacaaatgggtgtgtgaaatgagggagcccaacatgaagactaggatatggctaggaacttttccaacagccgatatggcagcccgagcccatgatgttgctgcaaaggcattgaggggacgctacgcctgtctcaatttcgcatactcggtgtggcggcttcctattccagcaacttcctcgataaaagatattcaaaaggcagcaacaaaagccgccgaagcttttagaccagaccatactataatgattaccgatattgagactgttgtagctgtcgtcgccacaaaggatctgaatatcttttgtggggaagaagagcatgaaatgttagatatgtctgagttgtggaggaatatggccctcatgtcccctacgcatagcttttcaaatgatcattatgaagatattcaagcacaagattttcaagatgatgaggtatcactatggaactattaaaaaaaaattgtttggtttaattttatttttggattgtagaataggaaatgtctatactacaacctttttaattggtagca

SEQ ID NO: 778 - protein, 214 aa, Medicago sativa
  G3498
MFTTNNSSYSHSISSKASSSYYNSLPDSEIRLAASNPKKRAGRKIFKETRHPVYRGVRKRNLDKWVCEMREPNMKTRIWLGTFPTADMAARAHDVAAKALRGRYACLNFAYSVWRLPIPATSSIKDIQKAATKAAEAFRPDHTIMITDIETVVAVVATKDLNIFCGEEEHEMLDMSELWRNMALMSPTHSFSNDHYEDIQAQDFQDDEVSLWNY

SEQ ID NO: 779 - DNA, 715 bp, Medicago sativa
  G3499
cttactactagtactactacatacaccccacaaatgaaatcatcacttgatgagtctagttacgtagagaacaactcttcttcatctgaaacaagttgctacgaagaaatcttgttagcatcagaacgaccaaagaaacctgcgggtagacgaaaattcaaagagacaagacatccagtttacagaggagtacgaaggaggaacaacaacaagtgggtttgtgaagtgcgtgttcctaacgacaagtccacgaggatttggctaggaacatatccaacacctgagatggcagcacgtgcacacgacgttgccgcactggcacttcgtggtaaatcagcttgtcttaattttgctaactccgcgtggcggttggcgttgccggagacgaacaatgcgaaggagattaggaaaatggcggcggaggctgctttggcatttgccgttgaggacagtaaggaacaaattatgattagtaattgtgatgtttgtagcagcgataatgttatggaagttgataataaacctttgcagggactgtgtgtggaagttccagagcaggaaatgttgcatgattggtttaggagtatggctgatgagcctttacgatctcctatgactccatttataagatatggtattggtagggatcactcaaataatgttgatgttgatccatgttgatcctgaggtgtgcttgtggaactttaccatctaa

SEQ ID NO: 780 - protein, 215 aa, Medicago sativa
  G3499
MKSSLDESSYVENNSSSSETSCYEEILLASERPKKPAGRRKFKETRHPVYRGVRRRNNNKWVCEVRVPNDKSTRIWLGTYPTPEMAARAHDVAALALRGKSACLNFANSAWRLALPETNNAKEIRKMAAEAALAFAVEDSKEQIMISNCDVCSSDNVMEVDNKPLQGLCVEVPEQEMLHDWFRSMADEPLRSPMTPFIRYGIGRDHSNNVDVDPC

SEQ ID NO: 781 - DNA, 1354 bp, Lycopersicon esculentum
  G3500
aaacaaggcaaaaaaagggttgtgttccaatgggtagagtcccttgttgtgataaaatgggagtgaagaaagggccatggactcctgaagaagatataatgttagtctcttatgtgcaacaacatggtccaggcaattggagggcacttcccactaaaacagggttgcgtaggtgtagcaagagctgcaggctaagatggacaaactaccttaggccagggataaagaggggtaacttcacagatcaagaagaaaaaatgattatccagcttcaagcacttttaggaaacaaatgggctgcaatagcttcgtatctgccagagagaacagataacgacataaaaaactactggaatactcatctaaagaaaaagatgaaaaggcttgaccaatgtcatggatcaaatgatctattttctttagaaaatgggcttactcacttatcatcttcaaattcatcaacttctaggggacaatgggaaaggacacttcaagctgatattaacatggctaaaaaggctttacataatgctttgtcacttgaaaatccaacaagctcacacaataataatattaaacaagaaaatacacaagtttcttctacttctactatttatgcatcaagtactgaaaatatagctagattgctacaaggatggataggatcaagtacttcttccacaaataattctgaaagttcaaaaacttcatcaaacaacattgcaacaactgattcatcttcatgtgatgggactccaaatgctgaaaccaaaggtggaatggggttgatggaagcatttgagtcactatttggtttggaatcatttgaatcatcaagttcagatgagttgtctcaaacaacaactcctgaggctattaaaattgaaataaagaaggaagaaaatgaacatgatgttgaagtgccactatctattatcttagagaattggttgcttgatgaaaatacactcaatattcaaccaaaaaatgacttgactaccttgatatcttttgatgaaactccacaacttttctacaagtttttttttttgttgattcttttgatggaataattttgaaaaaattgtatgtttttgattgatttccccattgattgtttttattttgatgtggcgattttaacaagtcatgtatatttagccattattattatatttagactatatatagctcaatcaagacttaatctagagtggttttatcatatgactaagttgtatcctttttaaatttcgttttatagatttcaattattgtactaagttagggaattttatatctctttcaatacaaaattttgttttattttaaaaaaaaaaaaaaaaaaaaaaaa

SEQ ID NO: 782 - protein, 347 aa, Lycopersicon esculentum
  G3500
MGRVPCCDKMGVKKGPWTPEEDIMLVSYVQQHGPGNWRALPTKTGLRRCSKSCRLRWTNYLRPGIKRGNFTDQEEKMIIQLQALLGNKWAAIASYLPERTDNDIKNYWNTHLKKKMKRLDQCHGSNDLFSLENGLTHLSSSNSSTSRGQWERTLQADINMAKKALHNALSLENPTSSHNNNIKQENTQVSSTSTIYASSTENIARLLQGWIGSSTSSTNNSESSKTSSNNIATTDSSSCDGTPNAETKGGMGLMEAFESLFGLESFESSSSDELSQTTTPEAIKIEIKKEENEHDVEVPLSIILENWLLDENTLNIQPKNDLTTLISFDETPQLFYKFFFLLILLME

SEQ ID NO: 783 - DNA, 1426 bp, Lycopersicon esculentum
  G3501
tataaacatagctagagaaaaaaaaaaaaaacttcaagaaaatcaaaagtgcttttgttgttgaattaaatcaaagaagatttgtttattttgatttttagaaatgggaaggcctccttgttgtgaaaaaagtggggtgaaaaaagggccatggacaccagaagaagatatcattttggtttcatacattcaagaacatggccctggaaactggagaaatattccaactaatactggtttgctaagatgcagcaaaagttgtagacttcgatggactaattatctccggccagggatcaaacgtggaaacttcactgaacatgaagaaaaaatgatcatccatcttcaagctcttcttggcaatcgatgggcagctatagcttcataccttccgcaaagaacagacaacgatatcaagaattactggaacactcatttgaaaaagaagcttaataacaacaagaaggttgaaggtcatgatgatcatcaagaaggaacttcagcatcatcatcatcatctcaatcaaaaatcataaaaggacagtgggaaaggaggcttcaaactgacattcacactgctaaacaagctctttgtgatgctttgtcacttgatacaactccaaataacaaaaacaacaacaataatccacctcctcatgatcaggatcaacaaccaccatcagttcaaacacctactacctatgcttcaagtgctgaaaacattgctaagttgcttcaaaattggatgaaaaattcacccaaatcgacctcgtctagtagctcgaaaattactcctatgtcatccttgaacaacaatttatcaatcggtgcagtttcaagttctagccctagtgaagggacggtaaatgttactcctggacaaggtttggactctatctttagctttaattcatctaataattcggatgtttcgcaatccgtatcggtcgatgagggtggtaatttcagtacacctgagaatcataataataacaacaacaacaatgctgggatttatcaagttgaaagcaagccaaatttgcctgatttcaagccagaaaatgggaattttcaagaggagagtaagcaaaatatggagacacaacaagtgcctttaactatgctggagaaatggctacttgaggatgctaatgcacaagctgaacaagaagatcagttaatgggaattggaatgggaatgggaatgacctttagctgaaactaatgatttgttttgaagaaaaaaaaaattgtttactagtactcccttcgtttcaatttatctgccttgatttgaccgaacatgaaagtgaagaaaaaaaataagtaaaacggataaattgaagcgcagggagtagtaaatatttcttcaaacaacataggacagtttggggtaagtgggcttttggggtattttaatagttgg

SEQ ID NO: 784 - protein, 371 aa, Lycopersicon esculentum
  G3501
MGRPPCCEKSGVKKGPWTPEEDIILVSYIQEHGPGNWRNIPTNTGLLRCSKSCRLRWTNYLRPGIKRGNFTEHEEKMIIHLQALLGNRWAAIASYLPQRTDNDIKNYWNTHLKKKLNNNKKVEGHDDHQEGTSASSSSSQSKIIKGQWERRLQTDIHTAKQALCDALSLDTTPNNKNNNNNPPPHDQDQQPPSVQTPTTYASSAENIAKLLQNWMKNSPKSTSSSSSKITPMSSLNNNLSIGAVSSSSPSEGTVNVTPGQGLDSIFSFNSSNNSDVSQSVSVDEGGNFSTPENHNNNNNNNAGIYQVESKPNLPDFKPENGNFQEESKQNMETQQVPLTMLEKWLLEDANAQAEQEDQLMGIGMGMGMTFS

SEQ ID NO: 785 - DNA, 936 bp, Oryza sativa
  G3502
atggggaggccgccgtgctgcgtgaaggcggaggtgaagaaggggccgtggacgccggaggaggacctcatgctcgtcgcctacgtccaggagcacggcccgggcaactggcgcgccgtgcccaccaacaccgggctgatgcggtgcagcaagagctgccggctccggtggaccaactacctccggccggggatcaagcgggggaacttcaccgaccaggaggagaagctcatcgtccacctccaggccctcctcggcaacaggaggtgggcggcgatcgcgtcctacttgccggagaggacggacaacgacatcaagaactactggaacacgcacctcaagaagaagctcaagaagatgagcgccaccggcggcggcggcgacgacggcgagggaggtggcgccggcgaggtgaagaccagggcggctgcgccgaaggggcagtgggagcggcgcctgcagacggacatccacaccgcgcgccaggcgctccgcgacgcgctctcgctggacccctcgccgccggccaagccgctggactcgtcgtcgggcgccacggcgccgccgtcgtcgcaggcggcgacgtcgtacgcatccagcgccgagaacatcgcgcggctcctggagggctggatgcgccccggcggcggcggcggcaagacgacgacgacgccgtcctccgggtcgaggtcgtcggcggcgtcggtgctgtccggggaggccagccacagcggcggcgccacggcgccgacgcccgacggctcgacggtcaccagcaagacgaaggacgaggagaccgccggcgcgccgccgccgccgccgccgccggcgttctccatgctggagagctggctgctcgacgacggcatgggccacggcgaggtggggctcatggacgtggtggtgccattgggggacccgagtgagttcttttag

SEQ ID NO: 786 - protein, 311 aa, Oryza sativa
  G3502
MGRPPCCVKAEVKKGPWTPEEDLMLVAYVQEHGPGNWRAVPTNTGLMRCSKSCRLRWTNYLRPGIKRGNFTDQEEKLIVHLQALLGNRRWAAIASYLPERTDNDIKNYWNTHLKKKLKKMSATGGGGDDGEGGGAGEVKTRAAAPKGQWERRLQTDIHTARQALRDALSLDPSPPAKPLDSSSGATAPPSSQAATSYASSAENIARLLEGWMRPGGGGGKTTTTPSSGSRSSAASVLSGEASHSGGATAPTPDGSTVTSKTKDEETAGAPPPPPPPAFSMLESWLLDDGMGHGEVGLMDVVVPLGDPSEFF

SEQ ID NO: 787 - DNA, 1672 bp, Glycine max
  G3537
gataattgagcttttcccagtgcagctacattgaatgtcacgcggtttcgagagagaggtatctatgaggtgaataattttggtccttactccttcagttaatgctcttgctgtcaacttttgacttggctacctggtttactagtttaagtcagcttctcatcacaccccacaccatacatatccttacccctttcatttttagctataaatgtgcatcaagcaaaggttaggctccgagacgtccgattagaaccctatcaagtaaagagggttagagaaataaaaagagaaagccgacagcacatagatagagagaggaaaacgacttaatattctttttccttgagacctgaaggggctaaggaaaattagaaggacacacaagtataaaggcggtgaaataaaagagaaagacaagaagaagacatgggaagaccaccttgttgtgacaaagaaggggtcaagaaagggccttggactcctgaagaagacatcatattggtgtcttatattcaggaacatggtcctggaaattggagggcagttcctgccaaaacagggttgtcaagatgcagcaagagttgcagacttagatggactaattacctgaggccaggaatcaaacggggcaacttcacagaacaagaggagaagatgataatccatcttcaagatcttttaggaaacagatgggctgcaatagcttcataccttccacagagaacagacaatgacataaagaactattggaacacccatttgagaaagaagctgaagaagatgcaagtaggttgtgaaggtggtagctttggagaagggttttcagcctcaaggcaaatccctagaggccagtgggaaagaaggctccaaactgatatccaaatggcaaagagagccctcagtgaagctctttcaccagagaagccatcttgtaatttatctgcctcaaactcaaacccttcagatagtagcagctccttctcttccacaaaaccaacaacaacacaaactgtgtgctatgcctcaagtgctgacaacatagctagaatgctaaagggttggatgaaaaacccaccaaagtcctcaagaacaaactcatcatctgtgactcagaactccttcaacaactttgctgcagcaggtgctgatactgcttctagtattggagcaaagggaccaccaagcagtgctgaattgtctgaaaacaattttgaatcattgtttgattttgatcagtctttggagtcttcaaactctgatgaattctctcggtcattgtctcctgaggccactgttttgcaagatgaaagcaagcctgatgttattggtgcagaaattatgccattctctttgcttgagaaatggcttcttgatgaggctggttgccaagagaaattagttggttgtggtgatgatgccaagtttttctaagttgggttcattttgtgacatatatgagactgtggaattttttattttatttcataagttataggtagggcctcatcaattaatcttcgctttggccttagagagagaagtttttcaagcctttggtgctagacgtgtatatgttaataactattgaaattatgattattgttatcatactgtgttagatgccacactggaaaacaagcaactaagatgtaaagttgatcctgcgatg

SEQ ID NO: 788 - protein, 334 aa, Glycine max
  G3537
MGRPPCCDKEGVKKGPWTPEEDIILVSYIQEHGPGNWRAVPAKTGLSRCSKSCRLRWTNYLRPGIKRGNFTEQEEKMIIHLQDLLGNRWAAIASYLPQRTDNDIKNYWNTHLRKKLKKMQVGCEGGSFGEGFSASRQIPRGQWERRLQTDIQMAKRALSEALSPEKPSCNLSASNSNPSDSSSSFSSTKPTTTQTVCYASSADNIARMLKGWMKNPPKSSRTNSSSVTQNSFNNFAAAGADTASSIGAKGPPSSAELSENNFESLFDFDQSLESSNSDEFSRSLSPEATVLQDESKPDVIGAEIMPFSLLEKWLLDEAGCQEKLVGCGDDAKFF

SEQ ID NO: 789 - DNA, 1342 bp, Glycine max
  G3538
ccccgcgcccccaccagtccgtaagaagaaaatcatgaaaagagagaaaagaagagagggagatagatatattatagctagctagatagagattagaagctatattattatatacataaagttatattatttatattgaactaaaagaaagggtacaagggaaagatgggaaggccaccatgttgtgataaaggtgtgaagaaaggaccttggactcctgaagaagacatcattttggtgtcttatattcaggaacatggtcctggcaattggaaagctgttcctgccaatactgggttgtcaaggtgcagtaagagttgtagacttagatggactaattacctgaggccaggaatcaaaaggggtaacttcacagaccaagaggagaagatgattatccatcttcaagcacttttagggaacagatgggctgcaatagctgcttacctaccacaaagaacagataatgacataaaaaactattggaacacatatttgaaaaagaagctgaacaaaaaattggaagcaggttctgatcaaggaagcttgttgggaggaggacataataatattgggttttcatcagtttctcaaccaatgtctagaggccagtgggaaagaaggcttcaaacagatattcacatggccaaaaaagcacttagtgaagcactctcaccaaacaaggcatcatcatcatcatcaaccttgttagctgaatcaaattcaaacctctccaatgaaaatagtaccttctataatagtaacactaataaaccaacaacaacacaatctatgtgctatgcttcaagtgctgacaacatagctcgtttgttgaaagggtggatgaaaaacacaccaaaatcagcctcatgtgctgcctcggctgtgactcaaaattcctgttcttctagtgaaggaattacaacaacaaagggaagcacaacaagcactagtactgttgaattgtctgagacttttgagtccttgtttggttatgagtctttcgataattactcttcaaattctgagttctcaccatctctttctcctgaggctactcttttccaagatgagggcaagccagatataactacaggattaatagacatgcctttctctttgcttgagaaatggcttctagatgttgatgctggtagtcaagagaaacttggcttctagattattagttcaatttgatatgttttttcttagttacaggagagtaagttaaatctctctctcactttggccctcaacccttcttttggttctagaagtgtatattccaatccaatgttcacattattatatgataaatctataataccactatcctataatt

SEQ ID NO: 790 - protein, 337 aa, Glycine max
  G3538
MGRPPCCDKGVKKGPWTPEEDIILVSYIQEHGPGNWKAVPANTGLSRCSKSCRLRWTNYLRPGIKRGNFTDQEEKMIIHLQALLGNRWAAIAAYLPQRTDNDIKNYWNTYLKKKLNKKLEAGSDQGSLLGGGHNNIGFSSVSQPMSRGQWERRLQTDIHMAKKALSEALSPNKASSSSSTLLAESNSNLSNENSTFYNSNTNKPTTTQSMCYASSADNIARLLKGWMKNTPKSASCAASAVTQNSCSSSEGITTTKGSTTSTSTVELSETFESLFGYESFDNYSSNSEFSPSLSPEATLFQDEGKPDITTGLIDMPFSLLEKWLLDVDAGSQEKLGF

SEQ ID NO: 791 - DNA, 1472 bp, Glycine max
  G3539
gaaataaaaagagaagaaagaaaacacgatagtatcatcatatcaccaccacacacatagatagagagaggaaaacgacctatattttttttcctttgagagcttcaggggctaggaaaattagaaggacagccacaagtataaaggcggtgaaataaaagagaaagacaagaaggagacatgggaagaccaccttgttgtgacaaagaaggggtcaagaaagggccttggactcctgaagaagacatcatattggtgtcttatattcaggaacatggtcctggaaattggagggcagttcctgccaaaacagggttgtcaagatgcagcaagagttgcagacttagatggacgaattacctgaggccaggaatcaagcgtggtaacttcacagaacaagaggagaagatgataatccatcttcaagatcttttaggaaacagatgggctgcaatagcttcataccttccacaaagaacagacaatgacataaagaactattggaatacccatttgagaaagaagctgaagaagatgcaagcaggcggtgaaggtggtagctttggagaagggttttcagcctcaaggcaaatccctagaggccagtgggaaagaaggctccaaactgatatccaaatggcaaagagagccctcagtgaagctctttcaccagagaaaaagccatcttgtaatttatctggcacaaactcaaacccttcagataggagcagctccatctcttccacaaaaccaacaacaacacaaactgtgtgctatgcatcaagtgctgacaacatagctagaatgctcaagggtgggatgaagaacccaccaaagtcctcaagaaccaactcgtctatgactcagaactcattcaacaacttagcaggtgctgatactgcttgtagtagtggagcaaagggaccactaagcagtgccgaattgtctgagaataattttgaatccttgtttgattttgatcagtctttggagtcttcaaactctgatcaattctctcagtccttgtctcctgaggccactgttttgcaagatgaaagcaagcctgatattaatattgctgcagaaattatgcccttctctttgcttgagaaatggctccttgatgaggcaggttgccaagagaaattagttggttgttgtggtgatgccaagtttttctaagttgggttcattttgtgacatatgagactgtgggatttttttattttattttattttatttcataagttataggtagggcctcatcaattaatctcgcttcggccttattagagagagaagttttccagcctttggtgctagacgtgtatatgttaattattattgacattatgatgattattatcatactgtgttagttgccatacactggcaaacttgcttctcttatgtaaagttgatcttgcgacgagatcttgctttatgaattaattgtttttaaagtaaaaaa

SEQ ID NO: 792 - protein, 333 aa, Glycine max
  G3539
MGRPPCCDKEGVKKGPWTPEEDIILVSYIQEHGPGNWRAVPAKTGLSRCSKSCRLRWTNYLRPGIKRGNFTEQEEKMIIHLQDLLGNRWAAIASYLPQRTDNDIKNYWNTHLRKKLKKMQAGGEGGSFGEGFSASRQIPRGQWERRLQTDIQMAKRALSEALSPEKKPSCNLSGTNSNPSDRSSSISSTKPTTTQTVCYASSADNIARMLKGGMKNPPKSSRTNSSMTQNSFNNLAGADTACSSGAKGPLSSAELSENNFESLFDFDQSLESSNSDQFSQSLSPEATVLQDESKPDINIAAEIMPFSLLEKWLLDEAGCQEKLVGCCGDAKFF

SEQ ID NO: 793 - DNA, 1369 bp, Zea mays
  G3540
gcaccagacggaatcgatcgatcggtgctttgatctctgagcctgagcaagcggtcgagctcaccaaccgccacgctcaagacaggtcgagtagctagctagctgccggagcggaaaaggaggcggtgcagtggcatggggaggccgccgtgctgcgacaagatgggggtgaagaaaggcccgtggacccccgaggaggacctcatgctcgtctcctatgtccaggagcacggccccgggaactggcgcgccgtgccgaccaacaccgggctgatgcggtgcagcaagagctgcaggttgcggtggacaaactacctccggccgggaatcaagcgcggcaactttaccgagcaggaggagaagctcatcgtccacctccaggctctccttggcaacaggtgggcggccatagcatcctacttgccgaagaggacggacaacgatatcaagaactactggaacacgcatcttaagaagaagctgaagaacatgcagggcggcgaagggggcgcgggagggaagcgcccggccgttcccaaggggcagtgggagcggcggctgcagactgacatccacacggcgcggcaggctctgcgcgacgcgctctcactggagccttcggcgacgccgctggccaaggtggagcctctgccgacggctccggggtgcgcgacgtacgcgtctagcgccgacaacatcgcgcggctgctggaggggtggctgcgcccgggcagcggcaaggggccggaggcgtcgggttcgacgtcgacgacggccacgacgcgccagcggccgcagtgctccggtgagggcacggcgtctgcgtcggcgagccacagtggcggggcggccgcgaacacggcggcgcagacccccgagtgctcgacggagaccagtaagatggccggcagctcggtcggcgcgggctccgcgccggcgttctcgatgctggagagatggctgctggacgacggcatggggcacgctgaggtggggctcatgaccgacgtggtgccattaggggaccccagtgagttcttttaattaaggcacaagtaccaccaaaagcaaactgatcaagtagagatgcaagaacaaaaagaagaaattaatcgccgggttaggtaactagttaagcagaaatccaacaaaactaaatgtatttgaattctcggtgaatttgatcgagttggatgtcgatatagtttttgttttagtcccttcttttatttttttctctgttgtttctctgatgttagggtttgtaactgatcatgtaagcttatactaatgacaggttcctaaatggaccctgcatgaaaatacatcttataaattaaaagatctatacaaaaaaaaaaaaaaaaaa

SEQ ID NO: 794 - protein, 302 aa, Zea mays
  G3540
MGRPPCCDKMGVKKGPWTPEEDLMLVSYVQEHGPGNWRAVPTNTGLMRCSKSCRLRWTNYLRPGIKRGNFTEQEEKLIVHLQALLGNRWAAIASYLPKRTDNDIKNYWNTHLKKKLKNMQGGEGGAGGKRPAVPKGQWERRLQTDIHTARQALRDALSLEPSATPLAKVEPLPTAPGCATYASSADNIARLLEGWLRPGSGKGPEASGSTSTTATTRQRPQCSGEGTASASASHSGGAAANTAAQTPECSTETSKMAGSSVGAGSAPAFSMLERWLLDDGMGHAEVGLMTDVVPLGDPSEFF

SEQ ID NO: 795 - DNA, 1225 bp, Zea mays
  G3541
gaattcccgggtcgaccctcgcggccgcggacgcgtgggcggacccgtggggccacaactccggccagaagctagctagccaagttattagctagtacatactagtggccggccggacacgatcgatgggcaggccgccgtgctgcgacaaggcgggggtcaagaaggggccatggacgccggaggaggacatcgtcctggtgtcctacgtccaggagcacggccccggcaactggcgcgccgtgcccgtcagcacgggcctcatgcgctgcagcaagagctgccgcctccgctggaccaactacctccgccccggcatccggcgcggcaacttcacaccccacgaggaaggcatcatcgtccacctccaggccttgctaggcaacagatgggcggccattgcttcttacctcccacagagaaccgacaacgacatcaagaactactggaacacccacctcaagaagaagctccggaagcagcaagccatcggcgccatcttcgcgccacctcccccctccgaacccaccgccggccatgccgattgccgtcgtcacgacatgacccgctcctccaaggacagccacgctgcttgcccggccgacagcacaccagcggctgatgaggtcgtcacccagctcatcgcccagcagttcgccgccaccgacggcgacacctcgtcgtcgtcgtcctactcgtacgcctccagcacggacaacatctccaagctgctgaacggcttcatgatgaagagcgcctcgccggcgcgggacgacgctaccgacaccatcaagacttcctcggccattgacatcgaccctttcgaccacaagtccggcggggccgcactaccaccacccaagaagcggcagcagcagcagcatctgtcctccatagagaactggttgttcgacgatgccactgagcagctcgttgtccagctgatggaggagatctccggcggctcatgctcagttcccatgctgctttattagcaccaagaaaaagaagcgaacatgcatgatagccgatcgatagatgtgacttggataggagaatgaatgtgtgcatgggtgcaagttacccagctgataggagaattttatatacaccaatatgcatgtttggttttatttacacaagcatgagccatgagacaagaacaatatatatgcatagttaatcaaaactcccaagcgagaggcacctcaaagaactcaaaaaa

SEQ ID NO: 796 - protein, 289 aa, Zea mays
  G3541
MGRPPCCDKAGVKKGPWTPEEDIVLVSYVQEHGPGNWRAVPVSTGLMRCSKSCRLRWTNYLRPGIRRGNFTPHEEGIIVHLQALLGNRWAAIASYLPQRTDNDIKNYWNTHLKKKLRKQQAIGAIFAPPPPSEPTAGHADCRRHDMTRSSKDSHAACPADSTPAADEVVTQLIAQQFAATDGDTSSSSSYSYASSTDNISKLLNGFMMKSASPARDDATDTIKTSSAIDIDPFDHKSGGAALPPPKKRQQQQHLSSIENWLFDDATEQLVVQLMEEISGGSCSVPMLLY

SEQ ID NO: 797 - DNA, 576 bp, Oryza sativa
  G3652
atgcaggccaacacgacgcagccggcgccggagaaggagacgaggtataagggcgtgcggctacggcagtgggggaaatgggtggcggagatccgactgcccaacagccgcaagaggatatggctgggatcctactacacaccggagaaggcggcgcgggcgttcgacgccgcgttcatatgtctccgcggcggtgaggccattgccgggctcaacttcaccgagtcaccgccggccgtcgtcgcccgcaccaccgacccgcgggaggtgctcgccttcgcgacgtcgcatgccaacctgctgtcgttgttggatgccgccattgcgcaagaagaagaagctcattctttcaaaaaagaagaagaagctcaggtggaggagaagacggctgaggagtcctcagacgtggtcagggcaaatgcggcgccaccaccgccggtgcaggtggcaggtgggagctttgactggtcacagctgccgctctactcgccaacgacaaccccagctgcagagcattgggaggaagataacgtcgaaggtactacaagtgataacctttggagcttcgatttctga

SEQ ID NO: 798 - protein, 191 aa, Oryza sativa
  G3652
MQANTTQPAPEKETRYKGVRLRQWGKWVAEIRLPNSRKRIWLGSYYTPEKAARAFDAAFICLRGGEAIAGLNFTESPPAVVARTTDPREVLAFATSHANLLSLLDAAIAQEEEAHSFKKEEEAQVEEKTAEESSDVVRANAAPPPPVQVAGGSFDWSQLPLYSPTTTPAAEHWEEDNVEGTTSDNLWSFDF

SEQ ID NO: 799 - DNA, 441 bp, Oryza sativa
  G3653
atgcaacctccggctacttcccgccaaaagctggagttgtttgaattctgccgacataatagttttctggatctctctctccatttcatgcaggccaacggtacgtcgccggcgccagtggagaggaagtacaggggcgtgcggctgcggcagtgggggaagtgggtggcggagattcggctgcccaacagcctcaagaggatatggctgggatcctacgactcgccggagaaggcggcgcgggcgttcgacgccgccttcatctgtctccgcggcggcgaggccatcgccggcctcaacttccccgagtcgccgcccaccgtcgttgcccgcactagcgacccgcgggaggtgctcgcctacgcgacgtcgcatgctaaccggctgggatgccaccattgcacaggaagaagcagctctggtggaggaggagacggctaa

SEQ ID NO: 800 - protein, 146 aa, Oryza sativa
  G3653
MQPPATSRQKLELFEFCRHNSFLDLSLHFMQANGTSPAPVERKYRGVRLRQWGKWVAEIRLPNSLKRIWLGSYDSPEKAARAFDAAFICLRGGEAIAGLNFPESPPTVVARTSDPREVLAYATSHANRLGCHHCTGRSSSGGGGDG

SEQ ID NO: 801 - DNA, 624 bp, Oryza sativa
  G3654
atgtcgtcgtcgtcttcggcgacgacgacgaagtataggggagtgcggctgcgcaagtgggggaagtgggtgtcggagatccggctgcccaacagccgcgagaggatatggctgggatcctacgacacgcccgaggaggcggcgcgggcgttcgacgccgcgttcgtctgcctccgcggcggcggcgaggccgccgggaacgggatcaacttccccggctcgccccctgccgtggcgcgcaccagcgacccgcaggaggtgtacgcggccgcggtgtcgcatgccaacaaccggccgccgccgccgccgtcggcccgagcaacgtcgtctgcacttccatgggaggaagctccggtggtggcggctcaggaggcggcggcggacatggcgcccgacgtggtggtgctgccatcgtcgccggtgaatgtgctggcagcagctgggagcttcgaatattggtcgcaacaaccactctactcgccgacggcagcaagcctcgatttgcagaggtggatgacggcggcggcggcggccgaggaatcaataatggaggatgacgacgacgaaggaacaagtgatggtctttggagtttccactactcaccgactcgttccaagtggtaa

SEQ ID NO: 802 - protein, 207 aa, Oryza sativa
  G3654
MSSSSSATTTKYRGVRLRKWGKWVSEIRLPNSRERIWLGSYDTPEEAARAFDAAFVCLRGGGEAAGNGINFPGSPPAVARTSDPQEVYAAAVSHANNRPPPPPSARATSSALPWEEAPVVAAQEAAADMAPDVVVLPSSPVNVLAAAGSFEYWSQQPLYSPTAASLDLQRWMTAAAAAEESIMEDDDDEGTSDGLWSFHYSPTRSKW

SEQ ID NO: 803 - DNA, 636 bp, Oryza sativa
  G3655
atgagctcaccgatggagccagtgtctttcatgcagaagagcgcggcggcggcggcggacggcggcagcgcggcgcaggcggcggcggagaggaggaaatacaagggcgtgcggctgcgtcagtgggggaagtgggcggcggagatccgtctgcccagcagctgcgagaggatatggctgggatcctacgacacgccggagaaggcggcgcgggcgttcgacgccgcgttcatctgcctccgcggcgtccaagccattgccgggctcaacttccccgagtccccgccgccgcctaccgccgcccgcaccggcgatctgcgtgaggtgtatgccttcgctgtgtcgcatgccaaccggccgtcggccgaagcggcgccggccgacattgttgttccagctcaggtcgcgaccgaggagtccgacggcgtggtgaggggaaatgcggcgccgccgccggtgcaggtggcggctgggagcttggactggtcgcagttcatggcaaacccaccacctatgtactcaccgacggcgacagccggaagccaggcgatgtggccggtgacagcaccggcagcagaagccgacggtgaggatgacgaattagctactacatgtcgttggagcttcgatgcctag

SEQ ID NO: 804 - protein, 211 aa, Oryza sativa
  G3655
MSSPMEPVSFMQKSAAAAADGGSAAQAAAERRKYKGVRLRQWGKWAAEIRLPSSCERIWLGSYDTPEKAARAFDAAFICLRGVQAIAGLNFPESPPPPTAARTGDLREVYAFAVSHANRPSAEAAPADIVVPAQVATEESDGVVRGNAAPPPVQVAAGSLDWSQFMANPPPMYSPTATAGSQAMWPVTAPAAEADGEDDELATTCRWSFDA

SEQ ID NO: 805 - DNA, 1146 bp, Zea mays
  G3656
ggcggtgaagatggaggcggagcaagcggcgatggcggcgccgcagctgggggcggcgcaccagcagacgcagccgcggcggcagtaccgcggcgtgcgcatgcgcaagtggggcaagtgggtggcggagatccgggagccgcacaagcgcacgcgcccccgcctccggtcctacgccacggccgtggcggcggcgcgcgcctacgacacggccgtgttctacctgcccggcccgtcggcgcggctcaacttccccgaggagatcccctcgttcgggctggcggatggcgtggacgtgggggagcacgcgcgcgacccggccgccgccgccgccggcggcggcggcggctgcacgctgtccgcggcgtccatacggaagaaggccatcgaggtggggtcccgcgtggacgcgctccagaccggcatggtggtcccgccgccgcaccaccgcgagcgccataggcaccacaaccacctgccgcagctgcgggtgcacgcggaggagcagcaggaggaagaggagcagaagccgcagcggcctgcgtggagcgggcgcgtcaagaacccggatctgaaccgtgcgccgagccccgagagctccgacgccgagtgacaagcgagcgagagcgcagcagcagccaccgcaaggcgaggttcaacgacgacgtccgttatcggttattcccaatcccacgacgcagcatgccgttgtcgtctccgtccgaccgtccccacgtacgtacgtacgtacgtacacgacgatccagctgaccctgccgcctgcctatcctatccgtcctcgacgacgaccggatggtcggcgggcgggagggagggcggtgcggcgagggttttgggtacgttgtggataagcacgagggcagcagcagcaggggcggcgtgcgcgggcaggcaggcgaagacggagggaggcggccacaagcggcggtctttccaaacgtcaaaaaggacagctgtaacagcgataagaaaaaacaagtcatcatcaccctcgtctcactactagttctactactgttcccgagagtagtagtaacgattagcactccactagcagtatgattattcgaatcggccttgcttgacagcgattaaaaaaaaaaaaaaaaaaaaaaaaaaaaaaaa

SEQ ID NO: 806 - protein, 200 aa, Zea mays
  G3656
MEAEQAAMAAPQLGAAHQQTQPRRQYRGVRMRKWGKWVAEIREPHKRTRPRLRSYATAVAAARAYDTAVFYLPGPSARLNFPEEIPSFGLADGVDVGEHARDPAAAAAGGGGGCTLSAASIRKKAIEVGSRVDALQTGMVVPPPHHRERHRHHNHLPQLRVHAEEQQEEEEQKPQRPAWSGRVKNPDLNRAPSPESSDAE

SEQ ID NO: 807 - DNA, 1035 bp, Arabidopsis thaliana
  G1048
gaccatggcggaggaatttggaagcatagatttactcggagatgaagatttcttcttcgatttcgatccttcaatcgtaattgattctcttccggcggaggattttcttcagtcttcaccggattcatggatcggagaaatcgagaatcaattgatgaacgatgagaatcatcaagaggagagttttgtggaattggatcagcaatcggtttcagatttcatagcggatctactcgttgattatccaactagcgattctggctccgttgatttggcggctgataaagttctaaccgtcgattctcccgccgccgctgatgattccgggaaggagaattcggatttggttgttgagaagaagtctaatgattctggtagcgagattcatgatgatgatgacgaagaaggagacgatgatgctgtggctaaaaaacgaagaaggagagtaagaaatagagatgcggcggttagatcgagagagaggaagaaggaatatgtacaagatttagagaagaagagtaagtatctcgaaagagaatgcttgagactaggacgtatgcttgagtgcttcgttgctgaaaaccagtctctacgttactgtttgcaaaagggtaatggcaataatactaccatgatgtcgaagcaggagtctgctgtgctcttgttggaatccctgctgttgggttccctgctttggcttctgggagtaaacttcatttgcctattcccttatatgtcccacacaaagtgttgcctcctacgtccagaaccagaaaagctggttctaaacgggctcgggagtagtagcaaaccgtcttataccggcgttagtcggagatgtaagggttcgaggcctaggatgaaataccaaatcttaacccttgcggcgtgacaacgccttttttaactgcttcttttgcgcattttgagttgtagatgagtgtcttttagttttctctctcttgttttgtatttcgctgttgaaagttttctgtctaatatcgataagttaacagtgaaaaaaaaaaaaaaaaa

SEQ ID NO: 808 - protein, 295 aa, Arabidopsis thaliana
  G1048 polypeptide
MAEEFGSIDLLGDEDFFFDFDPSIVIDSLPAEDFLQSSPDSWIGEIENQLMNDENHQEESFVELDQQSVSDFIADLLVDYPTSDSGSVDLAADKVLTVDSPAAADDSGKENSDLVVEKKSNDSGSEIHDDDDEEGDDDAVAKKRRRRVRNRDAAVRSRERKKEYVQDLEKKSKYLERECLRLGRMLECFVAENQSLRYCLQKGNGNNTTMMSKQESAVLLLESLLLGSLLWLLGVNFICLFPYMSHTKCCLLRPEPEKLVLNGLGSSSKPSYTGVSRRCKGSRPRMKYQILTLAA

SEQ ID NO: 809 - DNA, 909 bp, Arabidopsis thaliana
  G1100
atggtgcagcctggaaccgagataaaagcaagcgacctaaccctactagtaatcacgattatactcttcgcaatcttcatcgttggcttggcttcggtttgcttccgctggacctctcgccaattttactcacaagaatccatcaaccctttcactgactccgacgttgaatcccgtacgagtattacggcggtgcgtgggctcgacgaggctatcatcaactcatttccgacgtttctctactcggaggtgaaggagcggagaatcgggataggtggcgtcgagtgtgcagtgtgtatctgtgagttcgaagaccatgaaacgctccgtttgatgcctgaatgctgccacgtgtttcatgctgattgtgtaagtgtctggctctctgatcactccacgtgtccactctgtcgtgtggatctttgcttacaaccgggtgagagaagctacttgaatccggaaccggatcttgtagaatctacaaactcgcatttgtttgatggtgtgacgtggaccaataggaacagaccgtctcggtcatggtcaacgagattgtctcaatgtcgagtctcccagatattaatctcgagatcgcattcgaccggacattctgtggttcaaccgctagataatttagaccggtttacgcttcggttaccagaagaagtccggaggcaactgacgaaaaaaacggtggacaacgtggcattttctcaggctaggagctcacggcgtggttacagaagcagaagtgccggaagcgagaggagtgtcttctcgtaccaacggcggatgcattccttctctgattgtgcatggtccacctcctgtggcggagaagcggtggctccgtcaaaggattcccgccgaatatcagttgaacaatcccagctagatgatcgagtgtag

SEQ ID NO: 810 - protein, 302 aa, Arabidopsis thaliana
  G1100 polypeptide
MVQPGTEIKASDLTLLVITIILFAIFIVGLASVCFRWTSRQFYSQESINPFTDSDVESRTSITAVRGLDEAIINSFPTFLYSEVKERRIGIGGVECAVCICEFEDHETLRLMPECCHVFHADCVSVWLSDHSTCPLCRVDLCLQPGERSYLNPEPDLVESTNSHLFDGVTWTNRNRPSRSWSTRLSQCRVSQILISRSHSTGHSVVQPLDNLDRFTLRLPEEVRRQLTKKTVDNVAFSQARSSRRGYRSRSAGSERSVFSYQRRMHSFSDCAWSTSCGGEAVAPSKDSRRISVEQSQLDDRV

SEQ ID NO: 811 - DNA, 1265 bp, Arabidopsis thaliana
  G1796
ggaaactatcaaccaccaaaatctttcacattacaccttccttttgtcctcaaaccaaaaccctagaaaccaaaaatggaaaaagccttgagaaacttcaccgaatctacccactcaccagaccctaatcctctcacaaaattcttcactgaacctacagcctcacctgttagccgcaaccgcaaactgtcttcaaaagataccactgtaaccatcgccggagctggcagcagcacgacgaggtaccgcggcgtacgccggaggccgtggggacgatacgcggcggagatacgtgacccaatgtcgaaggagagacgttggctcggaacatttgacacggcggaacaagccgcttgtgcttacgactctgcggctcgtgcctttcgtggagcaaaggctcgtactaattttacttatccgacagctgtcattatgcctgaaccaaggttttctttttccaacaagaaatcttcgccgtctgctcgttgtcctcttccttctctaccgttagattcctctacccaaaacttttacggtgcaccggcagcgcagaggatctataatacacagtctatcttcttacgcgacgcctcgtgttcctctcgtaaaacgactccctataataactctttcaacggctcatcatcttcttactcagcatcgaaaacggcatgcgtttcttattccgaaaacgaaaacaacgagtcgtttttcccggaagaatcttctgatactggtctattacaagaggtcgttcaagagttcttgaagaaaaatcgcggcgttcctccttctccaccaacaccaccgccggtgactagccatcatgacaactctggttatttctctgctctcactatatactctgaaaatatggttcaagagactaaggagactttgtcgtcgaaactagatcgctacgggaattttcaagctaatgacgacggcgtaagagccgtcgcagacggtggtttatctttgggatcaaacgagtgggggtatcaagaaatgttgatgtacggaactcagttaggctgtacttgccgaagatcgtggggatagctagatattcatcatgattatgttttgagttttggtactatcgacttagtttaaagttgctacctttcccaatgttggatattaactaaattatgttttaagttgaatttgctaataggatttcataattataatcaagtttataatatattttagtagctaattaaagtttatatccacgtattctgaaaaaaaaaaaaaaa

SEQ ID NO: 812 - protein, 328 aa, Arabidopsis thaliana
  G1796 polypeptide
MEKALRNFTESTHSPDPNPLTKFFTEPTASPVSRNRKLSSKDTTVTIAGAGSSTTRYRGVRRRPWGRYAAEIRDPMSKERRWLGTFDTAEQAACAYDSAARAFRGAKARTNFTYPTAVIMPEPRFSFSNKKSSPSARCPLPSLPLDSSTQNFYGAPAAQRIYNTQSIFLRDASCSSRKTTPYNNSFNGSSSSYSASKTACVSYSENENNESFFPEESSDTGLLQEVVQEFLKKNRGVPPSPPTPPPVTSHHDNSGYFSALTIYSENMVQETKETLSSKLDRYGNFQANDDGVRAVADGGLSLGSNEWGYQEMLMYGTQLGCTCRRSWG

SEQ ID NO: 813 - DNA, 762 bp, Arabidopsis thaliana
  G1995
atggacgaggctaccggagaaacagaaactcaagatttcatgaacgtcgaatccttctctcagcttcctttcattcgccgtcctaaagataagaaccctaaacccattcgtgtcttcggaaaagatttcaccggcagagatttctctattactaccggtcaagaagactacaccgatccttaccagaccaaaaacaaagaagaagaagaggaagaagaccaaaccggagacaacagtacggacaataatagcatcagccacaacaggagattcgagtgtcactattgctttagaaattttcctacttcacaagccctaggtggacaccaaaacgctcacaaacgcgaacgtcagcttgccaaacgcggtgtttcctcttacttttatcatcctgacaataacccttacagttaccgtcattacccgtcgtggaccaatggtccgttaaccgcggctaggtcctatggaggattttcttctggtcctaagccgtcggggtattattcacgacccagctatgggagtcagttaggactatggcgtctaccgcctcgcgttcaaggcgtttataactcaaacgcagcgtttactagtaatggctcttcttcttcttctaattcgactttaccgttgttgacccgttctcaaactcaactatcatcgcaagtgggtggctccgctgctcagaacagaatgtcatcgtacggttacggattgagccctaacgtgcaagatcatgtgagtctcgatcttcatctttaa

SEQ ID NO: 814 - protein, 253 aa, Arabidopsis thaliana
  G1995 polypeptide
MDEATGETETQDFMNVESFSQLPFIRRPKDKNPKPIRVFGKDFTGRDFSITTGQEDYTDPYQTKNKEEEEEEDQTGDNSTDNNSISHNRRFECHYCFRNFPTSQALGGHQNAHKRERQLAKRGVSSYFYHPDNNPYSYRHYPSWTNGPLTAARSYGGFSSGPKPSGYYSRPSYGSQLGLWRLPPRVQGVYNSNAAFTSNGSSSSSNSTLPLLTRSQTQLSSQVGGSAAQNRMSSYGYGLSPNVQDHVSLDLHL

SEQ ID NO: 815 - DNA, 849 bp, Arabidopsis thaliana
  G2467
atggacccgtcgtcaagctccagagcacggtcaatgccaccgccggtgcctatggagggattgcaggaagcagggccttctccttttctaacaaagacgttcgagatggttggtgatccaaacacaaaccacattgtgtcttggaacaggggaggcatcagttttgtcgtgtgggatccacattccttctcggccactattctgcctctatacttcaagcacaacaacttctccagctttgtcagacaacttaacacttatggattcagaaagatcgaggcagagagatgggagtttatgaatgaaggtttcttgatgggtcagagggaccttctcaaaagcatcaagcgacgaacctcctcttcttcccctccttcgcttaactactctcagtctcagcccgaggctcatgacccaggcgtcgagcttccgcagctccgagaagagaggcatgtcctaatgatggagatctcgacgctcagacaggaggagcaaagagcgagaggctacgtccaagccatggagcagaggattaatggagcagagaagaaacagaggcatatgatgtccttcttgaggcgtgcggtggagaatccttcccttctgcagcagattttcgagcagaagagagaccgagaggaggccgcgatgattgatcaggctggcttgatcaaaatggaagaggtggagcacctgtcggagctggaggctctggcgcttgagatgcaaggatatggacggcaacggactgatggtgtggagagggagcttgacgacgggttttgggaagagttactcatgaacaatgaaaactccgacgaagaagaggcgaatgtgaagcaagattag

SEQ ID NO: 816 - protein, 282 aa, Arabidopsis thaliana
  G2467 polypeptide
MDPSSSSRARSMPPPVPMEGLQEAGPSPFLTKTFEMVGDPNTNHIVSWNRGGISFVVWDPHSFSATILPLYFKHNNFSSFVRQLNTYGFRKIEAERWEFMNEGFLMGQRDLLKSIKRRTSSSSPPSLNYSQSQPEAHDPGVELPQLREERHVLMMEISTLRQEEQRARGYVQAMEQRINGAEKKQRHMMSFLRRAVENPSLLQQIFEQKRDREEAAMIDQAGLIKMEEVEHLSELEALALEMQGYGRQRTDGVERELDDGFWEELLMNNENSDEEEANVKQD

SEQ ID NO: 817 - DNA, 1026 bp, Arabidopsis thaliana
  G2505
atgggttcttcgtcgaacggaggagtgccacctggtttccggtttcatccgacggacgaagagcttctccattactacttgaagaagaaaatctcttaccaaaagtttgagatggaagtcatcagagaggttgacttaaacaagcttgagccttgggatttgcaagagagatgcaagataggatcaacaccacaaaacgaatggtacttcttcagccacaaggacaggaaatatccgacggggtcaaggaccaaccgtgctactcatgcagggttctggaaggcgacgggacgtgacaagtgcataaggaactcttacaaaaagataggaatgaggaagacacttgtgttctacaaaggtagagctcctcatggccaaaagactgattggatcatgcatgagtaccgtcttgaagacgctgatgatcctcaagccaaccctagtgaagatggatgggtggtatgtagagtgtttatgaagaaaaatttgttcaaggtagtaaatgaaggtagctcaagcattaactcattggaccaacacaaccatgacgcatctaacaacaaccatgcacttcaagctcgtagctttatgcaccgagacagtccataccagctagtacgtaaccacggagccatgacattcgaacttaacaagcctgaccttgctcttcatcaatacccaccaatcttccacaagccaccttcacttggatttgactactcttcaggacttgcaagggacagtgagagtgcggctagtgaagggttacaataccagcaagcgtgtgagccgggtttagacgttggtacatgtgagacagtggctagtcataatcatcaacaaggtctaggtgaatgggcaatgatggatagacttgtgacttgtcacatgggaaatgaagattcctctagagggattacgtatgaggatggtaacaacaattcgtcctctgtggttcagccagttcccgcgacgaaccagctaacattgcgtagtgagatggatttctggggttattctaaatag

SEQ ID NO: 818 - protein, 341 aa, Arabidopsis thaliana
  G2505 polypeptide
MGSSSNGGVPPGFRFHPTDEELLHYYLKKKISYQKFEMEVIREVDLNKLEPWDLQERCKIGSTPQNEWYFFSHKDRKYPTGSRTNRATHAGFWKATGRDKCIRNSYKKIGMRKTLVFYKGRAPHGQKTDWIMHEYRLEDADDPQANPSEDGWVVCRVFMKKNLFKVVNEGSSSINSLDQHNHDASNNNHALQARSFMHRDSPYQLVRNHGAMTFELNKPDLALHQYPPIFHKPPSLGFDYSSGLARDSESAASEGLQYQQACEPGLDVGTCETVASHNHQQGLGEWAMMDRLVTCHMGNEDSSRGITYEDGNNNSSSVVQPVPATNQLTLRSEMDFWGYSK

SEQ ID NO: 819 - DNA, 1575 bp, Arabidopsis thaliana
  G2550
atggctgtgtattaccctaatagtgtcggcatgcaatctctttaccaagaatccatttacctcaacgaacaacaacaacaacaacaacaagcttcttcttcctctgctgcatctttctccgagattgtttccggtgatgttcgaaacaacgagatggtatttatcccaccaacaagcgacgtagccgtcaacggaaacgtaacggtgtcaagtaacgatctaagctttcacggtggaggactttctttaagtcttggtaatcagatccagtcagctgtctctgtttctccgtttcagtatcattaccagaatctttcgaaccaattgagttacaataatcttaatccttctactatgtctgatgagaatgggaagagcttgagtgttcatcagcatcactctgatcaaattttaccttcctctgtttacaacaacaatggtaataatggtgttggattctacaacaattaccgttacgagacatcagggtttgtgagtagtgtactgagatctcgttaccttaaaccaacacaacaattgcttgatgaagttgttagtgtaaggaaagatttgaaattggggaataagaagatgaagaatgataaaggtcaagactttcacaatgggtctagtgataacattacagaagatgataaatctcaatcgcaggagttgtctccttcagaacgtcaggagctacagagcaagaagagcaagcttttaacaatggtggatgaggtagataaaaggtataaccaataccatcatcaaatggaagctttagcatcgtctttcgagatggtaacaggtcttggagcagctaagccttacacatccgtagctctgaatagaatctctcgccatttccgctgtttacgcgacgcgataaaagaacagattcaggtgatcagagggaagcttggggagagagagacttctgatgaacaaggagagaggataccgcgtcttaggtacttagatcaacggttgagacaacagagagctttgcatcaacaacttggaatggttagaccagcttggagaccacaaagaggcttacctgaaaactctgtctctatacttcgagcttggctctttgagcatttccttcatccatatcctaaagaatcagagaaaatcatgctttcaaagcagacaggactatcgaaaaaccaggttgcaaattggtttattaacgcgagagttcgactatggaaaccaatgattgaagagatgtataaagaagagtttggagaatcagcagagttactctctaactctaatcaagacaccaaaaaaatgcaggaaacatctcagctcaaacacgaagactcttcgtcttcgcaacaacagaatcagggaaacaacaacaacaacatcccatatacatctgatgcagaacaaaacctagtctttgcagatcctaaaccagaccgtgctactactggagattacgacagcttgatgaactatcatgggtttggtattgatgattacaatcgttacgttggccttggaaaccaacaagatggcagatattctaatccccatcaattacacgactttgttgtctaa

SEQ ID NO: 820 - protein, 524 aa, Arabidopsis thaliana
  G2550 polypeptide
MAVYYPNSVGMQSLYQESIYLNEQQQQQQQASSSSAASFSEIVSGDVRNNEMVFIPPTSDVAVNGNVTVSSNDLSFHGGGLSLSLGNQIQSAVSVSPFQYHYQNLSNQLSYNNLNPSTMSDENGKSLSVHQHHSDQILPSSVYNNNGNNGVGFYNNYRYETSGFVSSVLRSRYLKPTQQLLDEVVSVRKDLKLGNKKMKNDKGQDFHNGSSDNITEDDKSQSQELSPSERQELQSKKSKLLTMVDEVDKRYNQYHHQMEALASSFEMVTGLGAAKPYTSVALNRISRHFRCLRDAIKEQIQVIRGKLGERETSDEQGERIPRLRYLDQRLRQQRALHQQLGMVRPAWRPQRGLPENSVSILRAWLFEHFLHPYPKESEKIMLSKQTGLSKNQVANWFINARVRLWKPMIEEMYKEEFGESAELLSNSNQDTKKMQETSQLKHEDSSSSQQQNQGNNNNNIPYTSDAEQNLVFADPKPDRATTGDYDSLMNYHGFGIDDYNRYVGLGNQQDGRYSNPHQLHDFVV

SEQ ID NO: 821 - DNA, 1113 bp, Arabidopsis thaliana
  G2640
atggcggggtttttctcgctagacggtggtggaggaggaggcggaggtggaggtaacaaccaagaagatcaccggagcaacacaaatcctcctccgcctgtatcagaagcttggctctggtatagaaaccctaacgttaacgcaaacgcaaacacaaacgttaacgcaaacgctccttcttcgtcaaacgctgctttaggaacacttgagttatggcaaaaccacaatcagcaagagatcatgtttcagcatcagcaacatcagcaaaggttggatctttactcttccgccgcaggtttaggtgttggaccaagtaatcataaccaattcgatatctccggcgaaacttcaaccgccggcgccggaagagctgcggcgatgatgatgattcgtagtggtggtagcggaggaggaagtggtggtgtgagctgtcaagactgtgggaatcaagcgaagaaagattgttctcacatgaggtgtagaacttgttgtaaaagccgtggcttcgagtgttctactcacgtgagaagcacgtgggtccctgctgctaaacgccgtgagagacaacagcaattagctacggtccagcctcaaactcagctgcctcgcggtgagagcgttcctaaacgccaccgtgaaaatttaccggcaacttcatcgtctcttgtctgcactcgcataccttctcattcagggctagaagttggcaatttcccggcggaggtgagttcatcggcggtgtttaggtgcgtgcgtgtgagctcagtagaagatggagaagaagagtttgcttaccaaacagctgtaagcattggtggtcacattttcaaaggcattttatacgacctcggtcctggaagtagtggtggcggaggctacaacgttgttgccgccggtgagagctcctctggtggtggtggagctcaacagctgaatctcataacagctggctctgtaaccgttgctaccgcttcttcctctactccaaacctcggtggtattggcagctcatcagccgcggcagccacgtacattgatccagccgctctttatccaactccgatcaatacattcatggccggtacacaattctttcccaacccaagatcatga

SEQ ID NO: 822 - protein, 370 aa, Arabidopsis thaliana
  G2640 polypeptide
MAGFFSLDGGGGGGGGGGNNQEDHRSNTNPPPPVSEAWLWYRNPNVNANANTNVNANAPSSSNAALGTLELWQNHNQQEIMFQHQQHQQRLDLYSSAAGLGVGPSNHNQFDISGETSTAGAGRAAAMMMIRSGGSGGGSGGVSCQDCGNQAKKDCSHMRCRTCCKSRGFECSTHVRSTWVPAAKRRERQQQLATVQPQTQLPRGESVPKRHRENLPATSSSLVCTRIPSHSGLEVGNFPAEVSSSAVFRCVRVSSVEDGEEEFAYQTAVSIGGHIFKGILYDLGPGSSGGGGYNVVAAGESSSGGGGAQQLNLITAGSVTVATASSSTPNLGGIGSSSAAAATYIDPAALYPTPINTFMAGTQFFPNPRS

SEQ ID NO: 823 - DNA, 726 bp, Arabidopsis thaliana
  G2686
atgttttcaaacatcgatcacaaggctgtggcagcactccttcatggccagggatgcgctaacatcctcaagacggtcctcgacaactgtaaagttagctctgtttcaacagaacctctcattaacaccattcttgattccttttcactagctctatcttctgtgaattctcctaatcgtcaaccacaccatgagtcttcttctcgagacatggcaggtcttgtgcctcaaagatcatcaaagaagaagatttgcggagtaaaaggtttagagatttacagagatgattcccccaatccccgccttgatgacggcttcacctggaggaaatatggacaaaaaaccatcaaaacctctttgtaccaaaggtgttactatcgttgtgcctatgcaaaagaccaaaactgctatgctacaaagcgggtgcagatgatccaagacagtcctccagtttacagaaccacttatttgggacaacatacatgtaaagcctttggggtgcatgataatacgtatggctctgaaatgataaacttcgaccaagttgtatctgaatcggttatgcgtcaacttgcaacaattggtgaacaagctgttctcatggaggacgaagctaaccatatcatgaaccaagaatatgatattaatgattatttggtggatgatgaagtcttttgggggaatgaatttcctctattttcatcggaagacctgatgttgttttga

SEQ ID NO: 824 - protein, 241 aa, Arabidopsis thaliana
  G2686 polypeptide
MFSNIDHKAVAALLHGQGCANILKTVLDNCKVSSVSTEPLINTILDSFSLALSSVNSPNRQPHHESSSRDMAGLVPQRSSKKKICGVKGLEIYRDDSPNPRLDDGFTWRKYGQKTIKTSLYQRCYYRCAYAKDQNCYATKRVQMIQDSPPVYRTTYLGQHTCKAFGVHDNTYGSEMINFDQVVSESVMRQLATIGEQAVLMEDEANHIMNQEYDINDYLVDDEVFWGNEFPLFSSEDLMLF

SEQ ID NO: 825 - DNA, 1440 bp, Arabidopsis thaliana
  G38
gaggaaaactcgaaaaagctacacacaagaagaagaagaaaagatacgagcaagaagactaaacacgaaagcgatttatcaactcgaaggaagagactttgattttcaaatttcgtcccctatagattgtgttgtttctgggaaggagatggcagtttatgatcagagtggagatagaaacagaacacaaattgatacatcgaggaaaaggaaatctagaagtagaggtgacggtactactgtggctgagagattaaagagatggaaagagtataacgagaccgtagaagaagtttctaccaagaagaggaaagtacctgcgaaagggtcgaagaagggttgtatgaaaggtaaaggaggaccagagaatagccgatgtagtttcagaggagttaggcaaaggatttggggtaaatgggttgctgagatcagagagcctaatcgaggtagcaggctttggcttggtactttccctactgctcaagaagctgcttctgcttatgatgaggctgctaaagctatgtatggtcctttggctcgtcttaatttccctcggtctgatgcgtctgaggttacgagtacctcaagtcagtctgaggtgtgtactgttgagactcctggttgtgttcatgtgaaaacagaggatccagattgtgaatctaaacccttctccggtggagtggagccgatgtattgtctggagaatggtgcggaagagatgaagagaggtgttaaagcggataagcattggctgagcgagtttgaacataactattggagtgatattctgaaagagaaagagaaacagaaggagcaagggattgtagaaacctgtcagcaacaacagcaggattcgctatctgttgcagactatggttggcccaatgatgtggatcagagtcacttggattcttcagacatgtttgatgtcgatgagcttctacgtgacctaaatggcgacgatgtgtttgcaggcttaaatcaggaccggtacccggggaacagtgttgccaacggttcatacaggcccgagagtcaacaaagtggttttgatccgctacaaagcctcaactacggaatacctccgtttcagctcgagggaaaggatggtaatggattcttcgacgacttgagttacttggatctggagaactaaacaaaacaatatgaagctttttggatttgatatttgccttaatcccacaacgactgttgattctctatccgagttttagtgatatagagaactacagaacacgttttttcttgttataaaggtgaactgtatatatcgaaacagtgatatgacaatagagaagacaactatagtttgttagtctgcttctcttaagttgttctttagatatgttttatgttttgtaacaacaggaatgaataatacacacttgtgaagcttttaaaaaaaaaaaaaaaaaaaaa

SEQ ID NO: 826 - protein, 335 aa, Arabidopsis thaliana
  G38 polypeptide
MAVYDQSGDRNRTQIDTSRKRKSRSRGDGTTVAERLKRWKEYNETVEEVSTKKRKVPAKGSKKGCMKGKGGPENSRCSFRGVRQRIWGKWVAEIREPNRGSRLWLGTFPTAQEAASAYDEAAKAMYGPLARLNFPRSDASEVTSTSSQSEVCTVETPGCVHVKTEDPDCESKPFSGGVEPMYCLENGAEEMKRGVKADKHWLSEFEHNYWSDILKEKEKQKEQGIVETCQQQQQDSLSVADYGWPNDVDQSHLDSSDMFDVDELLRDLNGDDVFAGLNQDRYPGNSVANGSYRPESQQSGFDPLQSLNYGIPPFQLEGKDGNGFFDDLSYLDLEN

SEQ ID NO: 827 - DNA, 997 bp, Arabidopsis thaliana
  G44
cacatacacatatacaacagagcaagagagtcaatcaagtagagtgaagatggcaactaaacaagaagctttagccatcgatttcataagccaacaccttctcacagactttgtttccatggaaactgatcacccatctctttttaccaaccaacttcacaactttcactcagaaacaggccctagaaccatcaccaaccaatcccctaaaccgaattcgactcttaaccagcgtaaaccgcccttaccgaatctatccgtctcgagaacggtttcaacaaagacagagaaagaggaagaagagaggcactacaggggagtgagacgaagaccgtggggaaaatacgcggcggagattagggatccgaacaaaaagggttgtaggatctggcttgggacttacgacactgccgtggaagctggaagagcttatgaccaagcggcgtttcaattacgtggaagaaaagcaatcttgaatttccctctcgatgttagggttacgtcagaaacttgttctggggaaggagttatcggattagggaaacgaaagcgagataagggttctccgccggaagaggagaaggcggctagggttaaagtggaggaagaagagagtaatacgtcggagacgacggaggctgaggttgagccggtggtaccattgacgccgtcaagttggatggggttttgggatgtgggagcaggagatggtattttcagtattcctccgttatctccgacgtctcccaacttttccgttatctccgtcacttaaaacttcggaaaagtcaacgtacgatgacgttttcacttgcgtcactctcatgatttcatttattcttgtataatataaaggtagcggtagtgtgcaaatatcaaataagtagtttaattagtaccaatcattttattcattattttttttagtagaatatttggatgttgaaaatataaatttaattttgtatttgttgatgttataaaaaaaaaaaaaaaa

SEQ ID NO: 828 - protein, 241 aa, Arabidopsis thaliana
  G44 polypeptide
MATKQEALAIDFISQHLLTDFVSMETDHPSLFTNQLHNFHSETGPRTITNQSPKPNSTLNQRKPPLPNLSVSRTVSTKTEKEEEERHYRGVRRRPWGKYAAEIRDPNKKGCRIWLGTYDTAVEAGRAYDQAAFQLRGRKAILNFPLDVRVTSETCSGEGVIGLGKRKRDKGSPPEEEKAARVKVEEEESNTSETTEAEVEPVVPLTPSSWMGFWDVGAGDGIFSIPPLSPTSPNFSVISVT

SEQ ID NO: 829 - DNA, 930 bp, Arabidopsis thaliana
  G230
atgtctggttcgacccggaaagaaatggatcggatcaaaggaccatggagtcctgaagaagacgatctgttacaatcgttggttcagaagcacggaccaaggaactggtctctgataagcaaatcaatccctggacgttccggtaaatcttgccgtctccgttggtgtaatcagctttctccggaggtagagcaccgtggattcacggcggaggaagatgatacgattatactagcgcacgctcggtttggtaacaagtgggcgacgattgcacggcttctcaatggtcgcactgataacgcgattaagaatcactggaactcaacgctgaagcggaaatgtagcggcggaggcggcggaggagaggaagggcagagttgtgatttcggtggtaatggagggtatgatggtaatttaactgatgaaaaaccgttaaaacggagggcgagtggtggaggaggagttgttgtggtgacggcgttaagtccaacgggatctgacgtcagcgagcaatcgcaatctagtggatctgttttaccggtttcttcttcttgtcatgtttttaaaccgacggcgagagctggtggagtggtgattgagtcatcatcgccggaggaggaggagaaagatccgatgacttgtttgaggttgtctttgccttgggtcaatgagtcaacaactccaccggagttgtttccggtgaagagagaagaagaagaagagaaggaaagagagatttctggacttggtggagattttatgacggtggtgcaggagatgattaagacggaggttaggagttacatggcggatttacagctaggaaacggcggaggagctggaggaggagcaagttcgtgtatggtgcaaggaactaatggtcgtaatgtagggtttagagagtttattggattaggtaggatcgagtag

SEQ ID NO: 830 - protein, 309 aa, Arabidopsis thaliana
  G230 polypeptide
MSGSTRKEMDRIKGPWSPEEDDLLQSLVQKHGPRNWSLISKSIPGRSGKSCRLRWCNQLSPEVEHRGFTAEEDDTIILAHARFGNKWATIARLLNGRTDNAIKNHWNSTLKRKCSGGGGGGEEGQSCDFGGNGGYDGNLTDEKPLKRRASGGGGVVVVTALSPTGSDVSEQSQSSGSVLPVSSSCHVFKPTARAGGVVIESSSPEEEEKDPMTCLRLSLPWVNESTTPPELFPVKREEEEEKEREISGLGGDFMTVVQEMIKTEVRSYMADLQLGNGGGAGGGASSCMVQGTNGRNVGFREFIGLGRIE

SEQ ID NO: 831 - DNA, 1904 bp, Arabidopsis thaliana
  G261
gctgcttgaaattctcttgtctgattaaaatatatatacccaagtccagaagctgtttaggttcgagaagcagagagggttcgagaagctaataagggtttcttctttttgattttaatgctaaaagggttctagattcgttgaattttacaagggttttaggggttcttagaagcttttgcttgattgtcttttatttagaaacagtggtgagtttttagtctttcactttgttcaagttcgaagctttttttggagggaattttgggcttctgattttgatcgaaacttactgatagtaagttctttgagtcctccttaactgtagtttctgtgtactgaagttattgaattgaaagtttttatcttttttggttattgaaactttcatagtttgatcaaaagagtctcttgctctgtttttggctctgtttttgtgagtgtgattgtaagctttgttgtgagtagattgaatcaaggagtgtgagagttgttaaaagtgttttcagagatggatgagaataatcatggagtttcatcaagctcacttccacctttcctcaccaaaacatatgagatggttgatgattcttcatccgattctatcgtctcttggagtcagagcaataagagtttcatcgtttggaatccgccggagttttctagagatcttcttccgagattcttcaagcacaataacttctctagctttatccgccagcttaacacatatggttttagaaaagctgatcctgagcaatgggaatttgcgaatgatgattttgtgagaggtcaacctcatcttatgaagaacattcatagacgcaaaccagttcatagccactctttaccgaatcttcaagctcagttaaacccgttgacggattcagaacgagtgagaatgaataatcagattgagagattgacaaaagagaaagaaggattgcttgaagagttacataaacaagacgaggaacgagaagtgtttgagatgcaagtgaaagaacttaaagaacgattacaacacatggagaagcgtcagaaaacaatggtttcgtttgtttctcaagtattggaaaagccagggcttgctttgaacctatcgccgtgtgttcccgaaacaaacgagaggaaaagaaggttccctaggatcgagttctttcccgatgaaccgatgttggaagagaacaaaacttgtgttgttgtgagagaggaaggttctacaagcccttcttcacacacaagagagcatcaagtggaacagttagagtcatcgatagcgatttgggagaatcttgtatcggattcttgtgagagtatgttacaatcaagaagtatgatgacacttgatgtggatgaatcatctacttttccagagagccctcctctttcttgcatacagttaagtgtcgattcacgtctcaaatctcctccttctccaaggatcatcgatatgaactgtgagcccgatggttcgaaagaacagaacactgttgctgctcctcctcctcctccagtagcaggagcgaatgatggcttctggcagcagtttttctcagagaatcctggctcaaccgagcaacgggaagttcaattagagaggaaagacgataaagataaagccggagtacgtactgagaaatgttggtggaattcgagaaatgttaatgcaattacagaacagcttggacatctgacttcttcagagagaagttgatatgtcaaagattaaatttctagtctgttttagttacttgtaaaatagggtttctcagttttattgttttcgattacagtacttaggtatggttcagctgtttatttatcacttgtatgatctttcacagttcattgtagcagacttcaatggtaatgataagctagagcttatggatagtattcat

SEQ ID NO: 832 - protein, 401 aa, Arabidopsis thaliana
  G261 polypeptide
MDENNHGVSSSSLPPFLTKTYEMVDDSSSDSIVSWSQSNKSFIVWNPPEFSRDLLPRFFKHNNFSSFIRQLNTYGFRKADPEQWEFANDDFVRGQPHLMKNIHRRKPVHSHSLPNLQAQLNPLTDSERVRMNNQIERLTKEKEGLLEELHKQDEEREVFEMQVKELKERLQHMEKRQKTMVSFVSQVLEKPGLALNLSPCVPETNERKRRFPRIEFFPDEPMLEENKTCVVVREEGSTSPSSHTREHQVEQLESSIAIWENLVSDSCESMLQSRSMMTLDVDESSTFPESPPLSCIQLSVDSRLKSPPSPRIIDMNCEPDGSKEQNTVAAPPPPPVAGANDGFWQQFFSENPGSTEQREVQLERKDDKDKAGVRTEKCWWNSRNVNAITEQLGHLTSSERS

SEQ ID NO: 833 - DNA, 1379 bp, Arabidopsis thaliana
  G271
ttaaggcaagaacttttctataaaatagatcttgactttcttcttctcctatctaagttcaattcatttgatattccttctaaaaatggggcaacaacaatcacagtccaaggatgagatgctgtttcaagaagtgagtaacaacaacgtcgaaggtatcaaatcacttcaccatgaaggagcaggactcgagggggtggataaattagggagaacaccattaatcttagcttgtacgaacgacgatctatatgatgtagcaaaaactctgcttgagttgggctccaatgtcaatgcttatcgttctggttgcaatggtgggactcctctgcaccatgctgcaaaaagaggtctcgtacacacggttaagttacttctgtctcacggtgcaaatccattggttcttgatgatgatgttaagacagctctcgaggttgctagagatgaaggttacagtaatgtcgtacgcgcaatcgagagtcatatctgcttgttctctggttgtatgcgtgagtattctggctccagcttgcttaatttatttgctcctcagcttctttcaagaaaagtatgggtagttgtcgtaccaactggttcaagaaaccctacaaagcctttaaagttggagttggttctgtatgatagtattcaggatgcacaaccaagaatggtgatacctttgtggaaagcaaacttagaggaaccaaaatcatttcggtgtgatgattcagtgatgattattgatgactccagaagtccaaagtccatgaggcagagaagagaaagcggattcatttctcaggcgaggcgttgggctcaagtcgatagagaaatacgtcttaagctagcagctgagatcaaaggcgacatgaaacagatgaattggttttctgaggcatgtaaaggagttccacagccaatgaatcctccaaggtttatgaaaacatctcaagcaacaacaacaacaaccaatgttcctgcactaagtgatgatgctttgactcgtgtcgccatgtcacttccttctccaaaaactgcgaataaagaagatggactgtgtgtgatttgtgtggatgcaccatctgaagcagtgtgtgtgccgtgtggacatgtcgccggatgcatttcttgcttgaaagagattgaaaacaagaaaatgggatgtcctgtttgtcgcgccaacattgatcaggtcattaagctatatcatgtttgaagcatatctcctctatggctggaagatattgaaactatctcctattttttactttgtctttaaaagataactacaaatttttttattgtgtgtatgttatgtggtgaagtcaaagaagtcgaaatatagaatcacgacaagtttagtttgtctttttatcaaa

SEQ ID NO: 834 - protein, 376 aa, Arabidopsis thaliana
  G271 polypeptide
MGQQQSQSKDEMLFQEVSNNNVEGIKSLHHEGAGLEGVDKLGRTPLILACTNDDLYDVAKTLLELGSNVNAYRSGCNGGTPLHHAAKRGLVHTVKLLLSHGANPLVLDDDVKTALEVARDEGYSNVVRAIESHICLFSGCMREYSGSSLLNLFAPQLLSRKVWVVVVPTGSRNPTKPLKLELVLYDSIQDAQPRMVIPLWKANLEEPKSFRCDDSVMIIDDSRSPKSMRQRRESGFISQARRWAQVDREIRLKLAAEIKGDMKQMNWFSEACKGVPQPMNPPRFMKTSQATTTTTNVPALSDDALTRVAMSLPSPKTANKEDGLCVICVDAPSEAVCVPCGHVAGCISCLKEIENKKMGCPVCRANIDQVIKLYHV

SEQ ID NO: 835 - DNA, 966 bp, Arabidopsis thaliana
  misc_feature (915)..(915): n is a, c, g, or t
  G359
atctctctctctctctctaagagacagacagacatagatatatcttagatttttcccaggggaaaaaacatagccaaaaagaaagagcttgcacatatggagagatcaaacagcatagagttgaggaacagcttctatggccgtgcaagaacttcaccatggagctatggagattatgataattgccaacaggatcatgattatcttctagggttttcatggccaccaagatcctacacttgcagcttctgcaaaagggaattcagatcggctcaagcacttggtggccacatgaatgttcacagaagagacagagcaagactcagattacaacagtctccatcatcatcttcaacaccttctcctccttaccctaaccctaattactcttactcaaccatggcaaactctcctcctcctcatcattctcctctaaccctatttccaaccctttctcctccatcctcaccaagatatagggcaggtttgatccgttccttgagccccaagtcaaaacatacaccagaaaacgcttgtaagactaagaaatcatctcttttagtggaggctggagaggctacaaggttcaccagtaaagatgcttgcaagatcctgaggaatgatgaaatcatcagcttggagcttgagattggtttgattaacgaatcagagcaagatctggatctagaactccgtttgggtttcgcttaattagatggtaataactttatccataaaggattcgaagttcacaattctagaagatatgatgcttctctaaggttaattagtttcatccatatgaaattctctaagcttgctatttagtagaacgttatagttgattatatgattatagtataagctataagcttgcgttagatgttatataatatgtatgcgcttgttaccgtntttatgtatgacaatggatacaattttgtctccttaattattgtttatctc

SEQ ID NO: 836 - protein, 204 aa, Arabidopsis thaliana
  G359 polypeptide
MERSNSIELRNSFYGRARTSPWSYGDYDNCQQDHDYLLGFSWPPRSYTCSFCKREFRSAQALGGHMNVHRRDRARLRLQQSPSSSSTPSPPYPNPNYSYSTMANSPPPHHSPLTLFPTLSPPSSPRYRAGLIRSLSPKSKHTPENACKTKKSSLLVEAGEATRFTSKDACKILRNDEIISLELEIGLINESEQDLDLELRLGFA

SEQ ID NO: 837 - DNA, 396 bp, Arabidopsis thaliana
  G377
atgggtctctcgcattttccaacagcgtcagaaggagtactaccacttctggtgatgaacacggttgtttcaatcactctgttgaagaacatggtgaggtctgtttttcaaattgttgcatccgagactgaatcttccatggagatagacgacgagcctgaagatgattttgttactagaagaatctcgataacacagttcaagtctctatgtgagaacatagaagaggaagaagaagagaaaggtgtggagtgttgtgtgtgcctttgtgggtttaaagaggaagaggaagtgagtgagttggtttcttgcaagcatttcttccacagagcttgtctagacaactggtttggtaataaccacaccacatgccctctttgcaggtccattctctag

SEQ ID NO: 838 - protein, 131 aa, Arabidopsis thaliana
  G377 polypeptide
MGLSHFPTASEGVLPLLVMNTVVSITLLKNMVRSVFQIVASETESSMEIDDEPEDDFVTRRISITQFKSLCENIEEEEEEKGVECCVCLCGFKEEEEVSELVSCKHFFHRACLDNWFGNNHTTCPLCRSIL

SEQ ID NO: 839 - DNA, 2238 bp, Arabidopsis thaliana
  G388
atggccgtcgacatgtcttccaaacaacccaccaaagactttttctcctctccagccctctctctatctctcgctgggatattccggaatgcatcctccggcagcaccaaccctgaggaggatttcctgggcagaagagtagttgacgatgaggatcgcactgtggagatgagcagcgagaactcaggacccacgagatccagatcagaggaggatttggagggtgaggatcacgacgatgaggaggaggaagaggaggacggcgcagctggaaacaagggcactaataagagaaagaggaagaagtatcatcgtcacaccaccgatcagatcagacacatggaagcgctattcaaagagacaccacatccggacgagaagcaaagacagcagctgagcaagcaactagggctggcccctcgccaggtcaagttctggttccaaaaccgccgcacacagatcaaggctattcaagaacggcacgagaactccctgctcaaggcggaactagagaagctgcgagaggaaaacaaagccatgagggagtctttttccaaggctaattcctcctgccccaactgcggaggaggccccgatgatctccacctcgaaaactccaaactgaaagccgagctcgataagcttcgtgcagctcttggacgcactccctatcccctgcaggcttcatgctccgacgatcaagaacaccgtctcggctctctcgatttctacacgggcgtctttgccctcgagaagtcccgtattgccgagatttctaaccgagccacccttgaactccagaagatggccacctcaggcgaacctatgtggctccgcagcgttgagactggccgtgagattctcaactacgatgagtacctcaaggagtttccccaagcgcaagcctcttcgtttcctggaaggaaaaccatcgaagcatctagagatgcggggattgtgtttatggacgcacataaacttgcccagagtttcatggacgtgggacaatggaaagagacatttgcatgcttgatctcaaaggctgcaacggtcgatgttatccggcaaggcgaagggccttcacggatcgacggggctattcagctgatgttcggagagatgcagctgctcactccggtcgtccccacaagagaagtgtacttcgtgagaagctgccggcagctgagccctgagaaatgggcaatagtggacgtctcggtctccgtggaggacagcaacacggagaaggaggcttctcttctgaaatgtcgaaaactcccctccggttgcatcatcgaggacacctccaacggtcactccaaggtcacctgggtggagcacctcgacgtgtctgcatccacagttcagcctctcttccgctccttagtcaacaccggtttggcctttggggctcgacactgggtcgccacccttcagctccattgcgaacgccttgtcttcttcatggctaccaacgtccccaccaaagactctctcggagttacaactcttgccgggagaaagagtgtgctgaagatggctcagagaatgacacaaagcttctaccgcgccattgctgcatcaagctaccatcaatggaccaaaatcaccaccaaaactggacaagacatgcgggtttcttccaggaagaaccttcatgatcctggcgagcccacgggagtcattgtctgcgcttcttcttcgctgtggttacctgtttctccagctcttctcttcgatttctttagagatgaagctcgtcggcatgagtgggatgctttgtcaaacggagctcatgttcagtctattgcaaacttatccaagggacaagacagaggcaactcagtggcaatccagacagtgaaatcgagagaaaagagcatatgggtgctgcaagacagcagcactaactcgtatgagtcggtggtggtatacgctcccgtagatataaacacgacacagctggtgctcgcgggacatgatccaagcaacatccaaatcctcccctctggattctcaatcatacctgatggagtagagtcacggccactggtaataacgtctacacaagacgacagaaacagccaaggagggtcgctcctgacactcgccctccaaaccctcatcaacccttctcctgcagcaaagctgaatatggagtctgtggaatccgtgacaaacctcgtctcagtcacactacacaacattaagagaagtctacaaatcgaagattgctga

SEQ ID NO: 840 - protein, 745 aa, Arabidopsis thaliana
  G388 polypeptide
MAVDMSSKQPTKDFFSSPALSLSLAGIFRNASSGSTNPEEDFLGRRVVDDEDRTVEMSSENSGPTRSRSEEDLEGEDHDDEEEEEEDGAAGNKGTNKRKRKKYHRHTTDQIRHMEALFKETPHPDEKQRQQLSKQLGLAPRQVKFWFQNRRTQIKAIQERHENSLLKAELEKLREENKAMRESFSKANSSCPNCGGGPDDLHLENSKLKAELDKLRAALGRTPYPLQASCSDDQEHRLGSLDFYTGVFALEKSRIAEISNRATLELQKMATSGEPMWLRSVETGREILNYDEYLKEFPQAQASSFPGRKTIEASRDAGIVFMDAHKLAQSFMDVGQWKETFACLISKAATVDVIRQGEGPSRIDGAIQLMFGEMQLLTPVVPTREVYFVRSCRQLSPEKWAIVDVSVSVEDSNTEKEASLLKCRKLPSGCIIEDTSNGHSKVTWVEHLDVSASTVQPLFRSLVNTGLAFGARHWVATLQLHCERLVFFMATNVPTKDSLGVTTLAGRKSVLKMAQRMTQSFYRAIAASSYHQWTKITTKTGQDMRVSSRKNLHDPGEPTGVIVCASSSLWLPVSPALLFDFFRDEARRHEWDALSNGAHVQSIANLSKGQDRGNSVAIQTVKSREKSIWVLQDSSTNSYESVVVYAPVDINTTQLVLAGHDPSNIQILPSGFSIIPDGVESRPLVITSTQDDRNSQGGSLLTLALQTLINPSPAAKLNMESVESVTNLVSVTLHNIKRSLQIEDC

SEQ ID NO: 841 - DNA, 627 bp, Arabidopsis thaliana
  G435
aacaaaagaaaaaacaaaaaagaagagaaaaatggagaattctcagagtcagggtaaaaacaagaagaagaggctaacacaagatcaagttagacaactggagaagtgcttcactatgaacaagaagcttgagccagatctgaaacttcaactgtcgaaccagcttggtctacctcaaagacaagtcgctgtctggttccaaaacaagcgagccaggttcaagactcagtctcttgaggtccaacactgcactcttcagtccaagcacgaagcagctctctccgacaaggcaaagttagagcatcaagtgcagtttctccaagatgagctgaagagagcaaggaatcagcttgctctgttcacaaatcaagattctcctgttgataattctaatcttggttcttgtgatgaagatcatgatgatcaagtggtggtattcgacgagctttacgcttgctttgttagcaatggacatggatcttcatcaacctcatgggtctgattctgtttcgacgcagacaagattccaatatatatagtcttgtctctgttttgtttcgtttgatctgtttctctttgtctgaatagatttaaaatttgtaattaaagtcattcagacattcacta

SEQ ID NO: 842 - protein, 156 aa, Arabidopsis thaliana
  G435 polypeptide
MENSQSQGKNKKKRLTQDQVRQLEKCFTMNKKLEPDLKLQLSNQLGLPQRQVAVWFQNKRARFKTQSLEVQHCTLQSKHEAALSDKAKLEHQVQFLQDELKRARNQLALFTNQDSPVDNSNLGSCDEDHDDQVVVFDELYACFVSNGHGSSSTSWV

SEQ ID NO: 843 - DNA, 1080 bp, Arabidopsis thaliana
  G442
caccacgtgtcttgtagccgtacatttaattgtcgtaagcaccacgcgtgttctcttagacggtatctagacatgtgttcccaccttaatttctgaaggctctggtgaattctaggacaatctatgcagacaaaaatttatagtttattgtttggttttatgttcgaaatttaatagtgattgtactgcgctccgtaatattttctacagtttgtacgtgttgtgtttttccaatggaaaaggaagataacggatcgaaacagagctcctctgcttctgttgtatcctcgagaagacgaagaagagtggttgagccagtggaagcgacgttacagagatgggaggaagaaggattggcgagagctcgtagggttcaagccaaaggttcgaagaaaggttgtatgagaggaaaaggtggaccagagaatcctgtttgtcggtttagaggtgttcgacaaagggtttgggggaaatgggttgctgagatacgtgaaccagtgagtcaccgtggtgcaaactctagtcgtagtaaacggctttggcttggcacgtttgctactgcagctgaagctgctttggcttacgacagagctgctagtgtcatgtacggaccctatgccaggttaaatttcccggaagatttgggtgggggaaggaagaaggacgaggaggcggaaagttcgggaggctattggttggaaactaacaaagccggtaatggcgtgattgaaacggaaggtggaaaagactatgtagtctacaatgaagacgctattgagcttggccatgacaagactcagaatcctatgactgataatgaaatagtgaacccagcagtgaaatcagaggaaggttacagctatgatcgattcaaattggataacggattgttgtataatgaacctcaaagctccagttatcaccagggaggtggattcgattcatattttgagtatttcagattctagcttaggatttatgctgcatcaatatactatgactatgagactatgttttttacattgttagtttactccattttcatttatcttaaaaaaaaaaaaaaaaaaaaaaaaaaaa

SEQ ID NO: 844 - protein, 244 aa, Arabidopsis thaliana
  G442 polypeptide
MEKEDNGSKQSSSASVVSSRRRRRVVEPVEATLQRWEEEGLARARRVQAKGSKKGCMRGKGGPENPVCRFRGVRQRVWGKWVAEIREPVSHRGANSSRSKRLWLGTFATAAEAALAYDRAASVMYGPYARLNFPEDLGGGRKKDEEAESSGGYWLETNKAGNGVIETEGGKDYVVYNEDAIELGHDKTQNPMTDNEIVNPAVKSEEGYSYDRFKLDNGLLYNEPQSSSYHQGGGFDSYFEYFRF

SEQ ID NO: 845 - DNA, 733 bp, Arabidopsis thaliana
  G468
ttactcatttgtcttaacctaaaattattataaaaaggatagagagagagagagagagctagagatatgggaagagggagaagttcatcgtcttcttcaatagagagtagcagcaagagcaacccattcggtgcttcgtcaagtactcgaaacctaagcacggacctgagactcggactcagcttcgggacatcctcagggactcaatatttcaacggtggctatgggtactccgttgcagctccggcggtagaggatgcggaatatgtggcggctgtggaggaggaagaagagaatgagtgtaacagtgtagggagcttttacgtgaaagtgaacatggaaggagttccaattggaagaaagatcgatctaatgtctcttaatggctaccgcgacttgatcagaacccttgatttcatgttcaacgcatccattctctgggctgaagaagaagacatgtgcaatgagaagagtcacgtgctaacgtacgcagataaggaaggtgactggatgatggttggagatgttccttgggagatgttcttgtctactgtgagaagactgaagatttcaagagctaattaccactactgatatataagtctacgtacttgttgtgtttaaatcgaagtaatgccaagaaaaaagtttttgcctgatgtaaatcaatggtcggatatttataatattattttcatttttctttaaaaaaaaaaaaaaaaaaaaaaaaaaa

SEQ ID NO: 846 - protein, 175 aa, Arabidopsis thaliana
  G468 polypeptide
MGRGRSSSSSSIESSSKSNPFGASSSTRNLSTDLRLGLSFGTSSGTQYFNGGYGYSVAAPAVEDAEYVAAVEEEEENECNSVGSFYVKVNMEGVPIGRKIDLMSLNGYRDLIRTLDFMFNASILWAEEEDMCNEKSHVLTYADKEGDWMMVGDVPWEMFLSTVRRLKISRANYHY

SEQ ID NO: 847 - DNA, 1888 bp, Arabidopsis thaliana
  G571
tagccgacctctcttctctcttctgaaaaaaacaccaaaggagctttaaatgctccgttacataatctctatctctttccaagaatatagagaaaggaaaataatatacaagaattaaaagaaggtatatcatcatctctctagctagtgatcaaagcaccgtcatcatcatcatatatcatcagcttgcctcagaggagaagaccaacataagagagatcgaagatcaaaatctatctctcttcatcatcttctgctgttactatcatatcacacgctctctcaaacatcatcctatatatagacttctcttcatcatcatcaaatgcaaggtcatcaccagaatcatcatcaacacttatcatcatcctccgccacgtcttcccatggaaacttcatgaacaaagatgggtatgatattggagagatagacccatcactcttcctctatcttgatggacaaggacatcatgatcctccatcaactgctccttctcctttacatcatcatcacacaactcagaatttggcgatgagacctccaacatcgacgctcaacatctttccatctcagcctatgcacatagagccacctccttcttctacacacaataccgataatacaagattagttccggctgctcaacctagtggttccactcgaccagcttctgacccgtccatggacttgaccaatcattctcagtttcatcaacctcctcaaggttctaaatccatcaagaaggaagggaaccgcaagggtcttgcctcatcggaccatgacatacctaaatcgtcagaccctaaaacattgagaagactagcacaaaacagagaagcagcaagaaaaagcagattacgtaaaaaggcttatgttcagcaactcgagtcatgtaggatcaaactgacccaactagaacaagagattcaacgggccagatcccaaggcgtattctttggagggtctcttataggaggagatcaacagcaaggtggactacccattggccctggcaacatcagctctgaagcagcggtgttcgatatggaatatgcgaggtggctggaggagcagcagaggctattaaacgaactaagggtggcaacacaagaacacttgtccgagaacgagcttaggatgtttgtggacacatgtttagctcattatgaccatttgattaacctcaaggctatggtcgctaagaccgatgtcttccacctcatttctggagcatggaaaactccagctgaacgttgcttcttgtggatgggtggtttccgtccatcggagatcattaaggtgattgtgaaccagatagaaccattgacggagcaacagatagttgggatatgtgggctgcaacagtccacacaagaggccgaggaggctctctcgcaaggcctcgaggcgttgaatcaatcactttccgatagcattgtctctgactccctcccgcctgcctccgcaccacttcctcctcatctatccaatttcatgtcacacatgtccttagctctcaacaagctctctgctctcgagggcttcgttctccaggcggataatttgaggcaccaaacgatccataggctgaaccaattgttgacgacccgtcaagaagcacggtgtcttctagccgttgcggagtacttccaccgtcttcaagctctaagttctctctggctagcccgtcctcggcaagatggataatactaaaacaactgatgaaggaaaccaaaaacaaaaacaagagaataggttgattagttagccgccagcttgacctctttatcatatatatcgtctctctactcaaatacagtgcaattagggaaaattgtttggcttctttttggtatatgattcttactattatgtttttaatcaaga

SEQ ID NO: 848 - protein, 460 aa, Arabidopsis thaliana
  G571 polypeptide
MQGHHQNHHQHLSSSSATSSHGNFMNKDGYDIGEIDPSLFLYLDGQGHHDPPSTAPSPLHHHHTTQNLAMRPPTSTLNIFPSQPMHIEPPPSSTHNTDNTRLVPAAQPSGSTRPASDPSMDLTNHSQFHQPPQGSKSIKKEGNRKGLASSDHDIPKSSDPKTLRRLAQNREAARKSRLRKKAYVQQLESCRIKLTQLEQEIQRARSQGVFFGGSLIGGDQQQGGLPIGPGNISSEAAVFDMEYARWLEEQQRLLNELRVATQEHLSENELRMFVDTCLAHYDHLINLKAMVAKTDVFHLISGAWKTPAERCFLWMGGFRPSEIIKVIVNQIEPLTEQQIVGICGLQQSTQEAEEALSQGLEALNQSLSDSIVSDSLPPASAPLPPHLSNFMSHMSLALNKLSALEGFVLQADNLRHQTIHRLNQLLTTRQEARCLLAVAEYFHRLQALSSLWLARPRQDG

SEQ ID NO: 849 - DNA, 606 bp, Arabidopsis thaliana
  G652
atgagcggaggaggagacgtgaacatgagtggtggagacagacgcaagggaacggtgaagtggtttgatacacagaaggggtttggtttcatcacacctagcgacggtggtgacgatctcttcgttcaccagtcttccatcagatctgaaggatttcgtagcctcgcagctgaggaatctgttgagttcgacgttgaggttgacaactccggccgtcccaaggctattgaagtgtctggacccgacggtgctcccgttcagggtaacagcggtggtggtggttcatctggtggacgcggtggttttggcggcggtggtggaagaggagggggacgtggtggaggaagctacggaggaggttatggtggaagaggaagcggtggccgtggaggaggtggtggtgataattcttgctttaagtgcggtgaaccaggtcacatggcgagagaatgctctcaaggtggtggaggatacagcggaggcgggggtggtggaaggtacgggtctggcggcggcggaggaggaggtggtggtggcttaagctgctacagctgtggagagtctgggcactttgcaagggattgcactagcggtggtgctcgttga

SEQ ID NO: 850 - protein, 201 aa, Arabidopsis thaliana
  G652 polypeptide
MSGGGDVNMSGGDRRKGTVKWFDTQKGFGFITPSDGGDDLFVHQSSIRSEGFRSLAAEESVEFDVEVDNSGRPKAIEVSGPDGAPVQGNSGGGGSSGGRGGFGGGGGRGGGRGGGSYGGGYGGRGSGGRGGGGGDNSCFKCGEPGHMARECSQGGGGYSGGGGGGRYGSGGGGGGGGGGLSCYSCGESGHFARDCTSGGAR

SEQ ID NO: 851 - DNA, 1087 bp, Arabidopsis thaliana
  G664
caatccctcaatataaaataacaagtagaattgatctgcctatatataagattttgagacgaaataagatctaaaccacaagaaagaaagtaaacataaaagtatgggaaggtcaccgtgctgtgagaaagctcacacaaacaaaggagcatggacgaaagaagaggacgagaggctcgtcgcctacattaaagctcatggagaaggctgctggagatctctccccaaagccgccggacttcttcgctgtggcaagagctgccgtctccggtggatcaactatctccggcctgaccttaagcgtggaaacttcaccgaggaagaagacgaactcatcatcaagctccatagccttcttggcaacaaatggtcgcttattgccgggagattaccgggaagaacagataacgagataaagaactattggaacacgcatatacgaagaaagcttataaacagagggattgatccaacgagtcatagaccaatccaagaatcatcagcttctcaagattctaaacctacacaactagaaccagttacgagtaataccattaatatctcattcacttctgctccaaaggtcgaaacgttccatgaaagtataagctttccgggaaaatcagagaaaatctcaatgcttacgttcaaagaagaaaaagatgagtgcccagttcaagaaaagttcccagatttgaatcttgagctcagaatcagtcttcctgatgatgttgatcgtcttcaagggcatggaaagtcaacaacgccacgttgtttcaagtgcagcttagggatgataaacggcatggagtgcagatgcggaagaatgagatgcgatgtagtcggaggtagcagcaaggggagtgacatgagcaatggatttgattttttagggttggcaaagaaagagaccacttctcttttgggctttcgaagcttggagatgaaataatattgtcaaattttaggcgtaactgtacaaaacttttgcctagataatttgaaagtatatcttcaacttgtatgagaaatttaactggtgaattataatatatagaatttgttttttaaaaaaaaaaaaaaaaaa

SEQ ID NO: 852 - protein, 282 aa, Arabidopsis thaliana
  G664 polypeptide
MGRSPCCEKAHTNKGAWTKEEDERLVAYIKAHGEGCWRSLPKAAGLLRCGKSCRLRWINYLRPDLKRGNFTEEEDELIIKLHSLLGNKWSLIAGRLPGRTDNEIKNYWNTHIRRKLINRGIDPTSHRPIQESSASQDSKPTQLEPVTSNTINISFTSAPKVETFHESISFPGKSEKISMLTFKEEKDECPVQEKFPDLNLELRISLPDDVDRLQGHGKSTTPRCFKCSLGMINGMECRCGRMRCDVVGGSSKGSDMSNGFDFLGLAKKETTSLLGFRSLEMK

SEQ ID NO: 853 - DNA, 1665 bp, Arabidopsis thaliana
  G772
aaaaaccaaaaccggtttttttttttctttttatgggtcgcgaatctctggctgttgtgtcctcgccgccatcggcgactgcgcccagtactgctgtgtcggctacctcgcttgctcctggctttcgatttcatccgactgatgaggaactcgtgagctattacttgaagaggaaggttctgggtaaacctgtacgcttcgatgcgattggagaggtagatatctacaagcatgagccctgggatttagcagtgttttcgaagttgaaaactcgggaccaagaatggtacttcttcagtgcgttagataagaagtacggtaatggtgctaggatgaatcgagcaactaacaaagggtactggaaagcaactggaaaagacagagaaatccgccgggatattcagttgctcggtatgaaaaagacgcttgttttccacagcgggcgtgctccagacggccttcggactaattgggtcatgcacgagtatcgccttgtggaatatgaaactgaaactaacggaagcctgctgcaggatgcatatgtgttgtgcagagtgtttcacaagaataacattgggccaccaagtgggaacagatatgcgccattcatggaagaagaatgggctgatggtggaggagctctgattccaggaatagacgttagggtcagggtagaggctctaccacaagccaatggaaacaaccagatggaccaggaaatgcattcagcaagcaaggatctcattaacatcaacgagctaccgagagatgctactccaatggacatcgaacctaaccaacagaatcatcatgagagtgccttcaagccacaggagagtaacaaccatagtggttatgaagaagatgaggacacactcaaacgcgagcacgcagaagaagatgagcgtcctccttctctatgcattctcaacaaagaagctccactacctctcctgcaatacaaacgtagacgccaaaacgagtccaacaacaactcaagcaggaacacacaggaccattgttcgtccacaataacaaccgtcgacaatacaaccaccttaatctcatcatctgctgctgctgctaccaacactgccatctctgcattgcttgagttctcacttatgggtatctccgacaagaaagaaaaccagcagaaagaggaaacttctcctcctagtccaattgcatctcctgaagagaaggttaatgatctccagaaggaggttcaccagatgtctgttgaaagagaaactttcaagcttgagatgatgagtgcagaggctatgatcagcattctccagtcaagaatcgatgcgctgcgtcaggagaacgaggaacttaagaagaagaacgccagtggacaagctagttaaaccaccgcaacatctctccaggtgtcttcttcttcttcttcttcttctttgcctcttagctgtaatcttcttaatagtatgagctatggatgtagcttcttcagacggatcagaaaccttatgaatctctgttgtaaaattaggataaaacggaacggagccaaccaactaggtctttttattttatccttttttactttggatgtttctgcatcttttgggaacattttcaggctgatccattgtcgtatattatcatctatctatctagtcttttcagacaaaaaaa

SEQ ID NO: 854 - protein, 447 aa, Arabidopsis thaliana
  G772 polypeptide
MGRESLAVVSSPPSATAPSTAVSATSLAPGFRFHPTDEELVSYYLKRKVLGKPVRFDAIGEVDIYKHEPWDLAVFSKLKTRDQEWYFFSALDKKYGNGARMNRATNKGYWKATGKDREIRRDIQLLGMKKTLVFHSGRAPDGLRTNWVMHEYRLVEYETETNGSLLQDAYVLCRVFHKNNIGPPSGNRYAPFMEEEWADGGGALIPGIDVRVRVEALPQANGNNQMDQEMHSASKDLININELPRDATPMDIEPNQQNHHESAFKPQESNNHSGYEEDEDTLKREHAEEDERPPSLCILNKEAPLPLLQYKRRRQNESNNNSSRNTQDHCSSTITTVDNTTTLISSSAAAATNTAISALLEFSLMGISDKKENQQKEETSPPSPIASPEEKVNDLQKEVHQMSVERETFKLEMMSAEAMISILQSRIDALRQENEELKKKNASGQAS

SEQ ID NO: 855 - DNA, 923 bp, Arabidopsis thaliana
  G798
gcatcacttcccttaaagcttcaaccttctccgatatgccgacgtcgactccggtgaaccacggcgaatagctatgaaacctaacggcgtaacagttccgatttctgaccagcaagaacagcttccatgtcctcgttgtgactcatccaacactaagttctgttactacaacaactacaacttctctcagcctcgtcacttctgcaaagcttgtcgtcgttactggactcacggtggtactctccgtgacgttcctgtcggtggtggtactcgtaaaagcgcgaaacgttcccgcacttgctcgaactcttcttcctcctctgtttctggtgtcgtctctaactctaacggtgttccgttacaaacgacgcctgttctcttccctcagtcgtcaatctctaacggcgttactcacacagtaactgaaagcgacggaaagggaagtgctttatctctctgtggaagtttcacctccactctgttgaaccataacgctcgtgcgacggctacgcatggatccggttcggttattggtatcggaggttttggaatcggactcgggtcgggttttgatgacgtcagctttggactcggaagagcgatgtggccgttttcaactgttggtactgcgacaacgacgaatgttgggagtaacggtggtcatcacgctgttccaatgccagccacgtggcagttcgagggtttagagagcaacgctggtggtggatttgtctccggtgagtactttgcgtggccggatctttccatcacaactccgggaaactcactcaaatgagaaaagcttctgtcttcatcaaagggcttcaaagtctcttcctttttttagtctctattggtgatgttgatctcttagtttgtgtcttgtcaatttagaaacttgtcttcggaaactagaaaacaga

SEQ ID NO: 856 - protein, 240 aa, Arabidopsis thaliana
  G798 polypeptide
MKPNGVTVPISDQQEQLPCPRCDSSNTKFCYYNNYNFSQPRHFCKACRRYWTHGGTLRDVPVGGGTRKSAKRSRTCSNSSSSSVSGVVSNSNGVPLQTTPVLFPQSSISNGVTHTVTESDGKGSALSLCGSFTSTLLNHNARATATHGSGSVIGIGGFGIGLGSGFDDVSFGLGRAMWPFSTVGTATTTNVGSNGGHHAVPMPATWQFEGLESNAGGGFVSGEYFAWPDLSITTPGNSLK

SEQ ID NO: 857 - DNA, 1120 bp, Arabidopsis thaliana
  G818
gtatttcttacaataaacgaccaaaaagttaatacaagaaatagaaacggtgtaggaagctactatgacggcaattccaaacgtcgtcgatattgaatcttcttcctcttcgctttgtcaagagacggcaacggagaccgtcaccgttgaaagaggctcgtctgattcatcttcaaagccagacgacgtcgttttactaatcaaggaagaggaggatgacgccgttaacttgtcacttggtttttggaaattgcacgagataggtttaataacaccgttcttgagaaagacgtttgagatcgtcgatgacaaagtaacagacccggttgtatcatggagcccgacccgtaaaagctttatcatttgggattcttacgagttctcagagaatctacttcccaaatacttcaagcacaagaacttctccagttttattcgtcagcttaactcttacggttttaaaaaggtcgattcagataggtgggaatttgctaacgaagggtttcaaggagggaagaaacatttgcttaagaacatcaagaggagaagcaaaaacactaaatgttgtaacaaggaagcgagtaccaccacgacagagactgaggttgagtcattgaaggaggaacagagtccaatgagattggagatgttgaagctgaaacaacaacaagaagaatctcaacatcagatggtcactgtgcaggagaagatccacggagttgataccgaacaacagcatatgcttagtttctttgcaaagttggctaaagatcaaagatttgtagagagactggtgaagaagagaaagatgaaaatacagagagagctagaagcagctgaattcgtgaagaagctcaagttgcttcaggatcaagaaactcaaaagaacttgttagatgtagaaagagaatttatggccatggctgcaacagaacacaatcccgagcctgacattttggtgaacaatcaaagcgggaatacgagatgtcagcttaactcagaggacctacttgttgacggtggctcaatggatgtaaatgggaggatagagatagagtagagcaaaaccggtaacatagcaatagagaaggtaccaaatcccaaggcttgagatccgaat

SEQ ID NO: 858 - protein, 331 aa, Arabidopsis thaliana
  G818 polypeptide
MTAIPNVVDIESSSSSLCQETATETVTVERGSSDSSSKPDDVVLLIKEEEDDAVNLSLGFWKLHEIGLITPFLRKTFEIVDDKVTDPVVSWSPTRKSFIIWDSYEFSENLLPKYFKHKNFSSFIRQLNSYGFKKVDSDRWEFANEGFQGGKKHLLKNIKRRSKNTKCCNKEASTTTTETEVESLKEEQSPMRLEMLKLKQQQEESQHQMVTVQEKIHGVDTEQQHMLSFFAKLAKDQRFVERLVKKRKMKIQRELEAAEFVKKLKLLQDQETQKNLLDVEREFMAMAATEHNPEPDILVNNQSGNTRCQLNSEDLLVDGGSMDVNGRIEIE

SEQ ID NO: 859 - DNA, 1430 bp, Arabidopsis thaliana
  G974
aaaaaaaaagttgatatactttctggttttctccttaacttttattctttacaaatccatcccccttagatctgtttatttcccgctactttgattcatttctgttagtaatctgtctttcgtatagaagaaaactgatttcttggtttgtattttcttaaagagatcaatctttttttatttttgatcttcttgtgtttttttttctttgtagaattaatcgtttgtgagggtatttttttaattccctcctctcagaaatctacacagaggttttttattttataaacctctttttcgattttcttgaaaacaaaaaatcctgttctttactttttttacaagaacaagggaaaaaaatttctttttattagaaatgacaacttctatggatttttacagtaacaaaacgtttcaacaatctgatccattcggtggtgaattaatggaagcgcttttaccttttatcaaaagcccttccaacgattcatccgcgtttgcgttctctctacccgctccaatttcatacgggtcggatctccactcattttctcaccatcttagtcctaaaccggtctcaatgaaacaaaccggtacttccgcggctaaaccgacgaagctatacagaggagtgagacaacgtcactggggaaaatgggtggctgagattcgtttaccgaggaatcgaactcgactttggctcggaacattcgacacggcggaggaagctgctttagcttatgacaaggcggcgtataagctccgaggagattttgcgcggcttaatttccctgatctccgtcataacgacgagtatcaacctcttcaatcatcagtcgacgctaagcttgaagctatttgtcaaaacttagctgagacgacgcagaaacaggtgagatcaacgaagaagtcttcttctcggaaacgttcatcaaccgtcgcagtgaaactaccggaggaggactactctagcgccggatcttcgccgctgttaacggagagttatggatctggtggatcttcttcgccgttgtcggagctgacgtttggtgatacggaggaggagattcagccgccgtggaacgagaacgcgttggagaagtatccgtcgtacgagatcgattgggattcgattcttcagtgttcgagtcttgtaaattagatgttgccataggggtattttagggactttagagctctctgcgatggagtttttggtcattgcagagattttattattattaagggggtttgttatgttaatatcaaataagtttatctactttgatgttaattagtgttaatctctgcgtcggtccaagctgtttttttttggcatgcttcgaccgtgtgagatttcttatgtaatttttgtagttccttgattttcttagttcaagttaaattggcacaaaaaaaaaaaaaaaaaa

SEQ ID NO: 860 - protein, 261 aa, Arabidopsis thaliana
  G974 polypeptide
MTTSMDFYSNKTFQQSDPFGGELMEALLPFIKSPSNDSSAFAFSLPAPISYGSDLHSFSHHLSPKPVSMKQTGTSAAKPTKLYRGVRQRHWGKWVAEIRLPRNRTRLWLGTFDTAEEAALAYDKAAYKLRGDFARLNFPDLRHNDEYQPLQSSVDAKLEAICQNLAETTQKQVRSTKKSSSRKRSSTVAVKLPEEDYSSAGSSPLLTESYGSGGSSSPLSELTFGDTEEEIQPPWNENALEKYPSYEIDWDSILQCSSLVN

SEQ ID NO: 861 - DNA, 2026 bp, Arabidopsis thaliana
  G1062
caaaaaaaaagtttcaatttttgaaagctctgagaaatgaaatctatcattctctctctctatctctatcttccttttcagatttcgcttcttcaattcatgaaatcctcgtgattctactttaatgcttctctttttttacttttccaagtctctgaatattcaaagtatatatcttttgttttcaaacttttgcagaattgtcttcaagcttccaaatttcagttaaaggtctcaactttgcagaattttcctctaaaggttcagactttggggtaaaggtgtcaactttggcgatgggtcttgacggaaacaatggtggaggggtttggttaaacggtggtggtggagaaagggaagagaacgaggaaggttcatggggaaggaatcaagaagatggttcttctcagtttaagcctatgcttgaaggtgattggtttagtagtaaccaaccacatccacaagatcttcagatgttacagaatcagccagatttcagatactttggtggttttccttttaaccctaatgataatcttcttcttcaacactctattgattcttcttcttcttgttctccttctcaagcttttagtcttgacccttctcagcaaaatcagttcttgtcaactaacaacaacaagggttgtcttctcaatgttccttcttctgcaaacccttttgataatgcttttgagtttggctctgaatctggttttcttaaccaaatccatgctcctatttcgatggggtttggttctttgacacaattggggaacagggatttgagttctgttcctgatttcttgtctgctcggtcacttcttgcgccggaaagcaacaacaacaacacaatgttgtgtggtggtttcacagctccgttggagttggaaggttttggtagtcctgctaatggtggttttgttgggaacagagcgaaagttctgaagcctttagaggtgttagcatcgtctggtgcacagcctactctgttccagaaacgtgcagctatgcgtcagagctctggaagcaaaatgggaaattcggagagttcgggaatgaggaggtttagtgatgatggagatatggatgagactgggattgaggtttctgggttgaactatgagtctgatgagataaatgagagcggtaaagcggctgagagtgttcagattggaggaggaggaaagggtaagaagaaaggtatgcctgctaagaatctgatggctgagaggagaaggaggaagaagcttaatgataggctttatatgcttagatcagttgtccccaagatcagcaaaatggatagagcatcaatacttggagatgcaattgattatctgaaggaacttctacaaaggatcaatgatcttcacaatgaacttgagtcaactcctcctggatctttgcctccaacttcatcaagcttccatccgttgacacctacaccgcaaactctttcttgtcgtgtcaaggaagagttgtgtccctcttctttaccaagtcctaaaggccagcaagctagagttgaggttagattaagggaaggaagagcagtgaacattcatatgttctgtggtcgtagaccgggtctgttgctcgctaccatgaaagctttggataatcttggattggatgttcagcaagctgtgatcagctgttttaatgggtttgccttggatgttttccgcgctgagcaatgccaagaaggacaagagatactgcctgatcaaatcaaagcagtgcttttcgatacagcagggtatgctggtatgatctgatctgatcctgacttcgagtccattaagcatctgttgaagcagagctagaagaactaagtccctttaaatctgcaattttcttctcaactttttttcttatgtcataacttcaatctaagcatgtaatgcaattgcaaatgagagttgtttttaaattaagcttttgagaacttgaggttgttgttgttggatacataacttcaaccttttattagcaatgttaacttccatttatgtttcatctt

SEQ ID NO: 862 - protein, 494 aa, Arabidopsis thaliana
  G1062 polypeptide
MGLDGNNGGGVWLNGGGGEREENEEGSWGRNQEDGSSQFKPMLEGDWFSSNQPHPQDLQMLQNQPDFRYFGGFPFNPNDNLLLQHSIDSSSSCSPSQAFSLDPSQQNQFLSTNNNKGCLLNVPSSANPFDNAFEFGSESGFLNQIHAPISMGFGSLTQLGNRDLSSVPDFLSARSLLAPESNNNNTMLCGGFTAPLELEGFGSPANGGFVGNRAKVLKPLEVLASSGAQPTLFQKRAAMRQSSGSKMGNSESSGMRRFSDDGDMDETGIEVSGLNYESDEINESGKAAESVQIGGGGKGKKKGMPAKNLMAERRRRKKLNDRLYMLRSVVPKISKMDRASILGDAIDYLKELLQRINDLHNELESTPPGSLPPTSSSFHPLTPTPQTLSCRVKEELCPSSLPSPKGQQARVEVRLREGRAVNIHMFCGRRPGLLLATMKALDNLGLDVQQAVISCFNGFALDVFRAEQCQEGQEILPDQIKAVLFDTAGYAGMI

SEQ ID NO: 863 - DNA, 1219 bp, Arabidopsis thaliana
  G1129
tcgactctttctccactctctctctctctcgttgcaagcaacttgttttctgaatccaaagaagacgataacgatgaatggagctataggaggtgaccttttgctcaattttcctgacatgtcggtcctagagcgccaaagggctcacctcaagtacctcaatcccacctttgattctcctctcgccggcttctttgccgattcttcaatgattaccggcggcgagatggacagctatctttcgactgccggtttgaatcttccgatgatgtacggtgagacgacggtggaaggtgattcaagactctcaatttcgccggaaacgacgcttgggactggaaatttcaagaaacggaagtttgatacagagactaaggattgtaatgagaagaagaagaagatgacgatgaacagagatgacctagtagaagaaggagaagaagagaagtcgaaaataacagagcaaaacaatgggagcacaaaaagcatcaagaagatgaaacacaaagccaagaaagaagagaacaatttctctaatgattcatctaaagtgacgaaggaattggagaaaacggattatattcatgttcgtgcacgacgaggccaagccactgatagtcacagcatagcagaacgagttagaagagaaaagatcagtgagagaatgaagtttctacaagatttggttcctggatgcgacaagatcacaggcaaagcagggatgcttgatgaaatcattaactatgttcagtctcttcagagacaaatcgagttcttatcgatgaaactagcaattgtgaatccaaggccggattttgatatggatgacatttttgccaaagaggttgcctcaactccaatgactgtggtgccatctcctgaaatggttctttccggttattctcatgagatggttcactctggttattctagtgagatggttaactccggttaccttcatgtcaatccaatgcagcaagtgaataccagttctgatccattgtcatgcttcaacaatggcgaagctccttcgatgtgggactctcatgtgcagaatctctatggcaatttaggagtttgattaagaaaccaatccacaacataacaatgttccctaattcaaattattcatcggaagagagagcaaaccagtagctgttatttactaattccactagattattgacttgagatcccccgcccattagttgatgtatca

SEQ ID NO: 864 - protein, 335 aa, Arabidopsis thaliana
  G1129 polypeptide
MNGAIGGDLLLNFPDMSVLERQRAHLKYLNPTFDSPLAGFFADSSMITGGEMDSYLSTAGLNLPMMYGETTVEGDSRLSISPETTLGTGNFKKRKFDTETKDCNEKKKKMTMNRDDLVEEGEEEKSKITEQNNGSTKSIKKMKHKAKKEENNFSNDSSKVTKELEKTDYIHVRARRGQATDSHSIAERVRREKISERMKFLQDLVPGCDKITGKAGMLDEIINYVQSLQRQIEFLSMKLAIVNPRPDFDMDDIFAKEVASTPMTVVPSPEMVLSGYSHEMVHSGYSSEMVNSGYLHVNPMQQVNTSSDPLSCFNNGEAPSMWDSHVQNLYGNLGV

SEQ ID NO: 865 - DNA, 1311 bp, Arabidopsis thaliana
  G1137
tacttcagacttctactcaaaccagtcacgtagttggttggtgacatttcgctgcatttttcaatctgtgattgtttttcgttcgtctttcttttactattttctcgaaaaggacacaagaagtattgcattcactcagttgagcaacttaacaatcgtgttgtactttttgaagttcccttgagctaaactgctaagagcatgcctctggataagaggcaacgggatttgcctctgggcttaagtcctcaagcttgcttcaaggatatagtaggtcggtctgtccttcctagaattcctctccctgagcttgggaaactatatgcagctaagcttcaggctcgctgtttgcagccaccaccattccagtctttgctgtgcagtcatgataaggagtcttatggaaaaagattctcacggtctgacatgcggtcttggtgcgctgctgctactactactactactccacttggagcattagagtcttctcagaaaagacttttgatattcgatcagtcaggagaccagactcgtctattacaatgtccatttcctctacggtttccatctcatgcggctgcagaaccagtgaaactctctgagttacaaggtatagagaaagctttcaaagaagatggtgaagagtttcacaagagtgatggaacagagtcagaaatgcatgaagacactgaggagatcaatgcattgctatattcagatgatgattatgatgatgattgcgagagtgatgatgaagtaatgagcactggtcactctccttatccaaatgaaggagtttgcaacaaaagggaattagaagaaatcgatggtccttgtaaaaggcagaaactactggataaggtcaacaacatcagcgacttatcatcacttgtgggcactgagagctccacacaactcaatggatcttcctttcttaaggacaaaaagctccctgaatcaaaaaccatatcgaccaaagaggacactggttctggtctgagcaacgagcagtcgaagaaagacaagatccgcacagctctgaaaatactcgagagcgtagtccctggtgcaaaaggaaacgaagcgctcttacttctggacgaagcaattgattacctaaagttgctgaaacgagacttaatctccacagaggttaagaaccaaagctccaccactcacaagtcaccaatcttgttgcttaaagagacaacatggggaacaagaaatctgcagacagataaggcgtgaaagattctgacgagttaaaacgtgtgaagtgggtttttgggtacgtatccttgcaccagcttt

SEQ ID NO: 866 - protein, 348 aa, Arabidopsis thaliana
  G1137 polypeptide
MPLDKRQRDLPLGLSPQACFKDIVGRSVLPRIPLPELGKLYAAKLQARCLQPPPFQSLLCSHDKESYGKRFSRSDMRSWCAAATTTTTPLGALESSQKRLLIFDQSGDQTRLLQCPFPLRFPSHAAAEPVKLSELQGIEKAFKEDGEEFHKSDGTESEMHEDTEEINALLYSDDDYDDDCESDDEVMSTGHSPYPNEGVCNKRELEEIDGPCKRQKLLDKVNNISDLSSLVGTESSTQLNGSSFLKDKKLPESKTISTKEDTGSGLSNEQSKKDKIRTALKILESVVPGAKGNEALLLLDEAIDYLKLLKRDLISTEVKNQSSTTHKSPILLLKETTWGTRNLQTDKA

SEQ ID NO: 867 - DNA, 1164 bp, Arabidopsis thaliana
  G1425
actctctcaaaccataaaaaatattctccgatcatcattttaatggagagtacagattcttccggtggtcctccgccgccgcaaccaaacctccctccaggattccggtttcatccaacagacgaagaacttgtaattcattacctcaaacgcaaagcagattctgttcctttaccagtcgcgatcatcgccgacgttgatctttacaaatttgatccatgggaacttcccgcgaaagcttcgtttggagaacaagaatggtattttttcagtccaagagatcggaaatatcccaacggagctagacctaaccgagctgcgacttccggttattggaaagcgactggtacagataaaccggtgatttcaaccggcggtggtggtagtaaaaaagtgggagttaaaaaggctctagtgttttacagtggtaaaccaccaaaaggagttaaatcagattggattatgcatgaatatcggttaactgataataaacctactcacatttgtgacttcggcaacaagaaaaactctctcaggcttgatgattgggtgttgtgtcgtatctacaagaaaaacaatagtacagcatctagacatcatcatcatcttcatcatattcatctagataatgatcatcatcgtcatgatatgatgattgatgatgatcgattccgtcatgttcctcctggtcttcacttcccggcgattttttctgacaataatgatccgacggctatatatgatggtggcggcggcggatacggaggtggaagttactcgatgaatcattgtttcgcatctggatcaaagcaggagcagttgtttccaccggtgatgatgatgactagtctaaatcaagattccggtattggatcgtcgtcgtcacctagcaagagatttaacggcggcggcgttggagattgttcgacttctatggcggcgacgccgttaatgcagaaccaaggtgggatttaccaattgcctggtttgaattggtattcttgaaaacaatttacgatgaagaatttttaaaatttgtgtatatatatacggtttgagtgattagggggcattgggggatttatttacggttgattattattgtagtgttatagaactaaggagattaaattaaatagattggaggaaaaaaaaaaaaaaaaa

SEQ ID NO: 868 - protein, 320 aa, Arabidopsis thaliana
  G1425 polypeptide
MESTDSSGGPPPPQPNLPPGFRFHPTDEELVIHYLKRKADSVPLPVAIIADVDLYKFDPWELPAKASFGEQEWYFFSPRDRKYPNGARPNRAATSGYWKATGTDKPVISTGGGGSKKVGVKKALVFYSGKPPKGVKSDWIMHEYRLTDNKPTHICDFGNKKNSLRLDDWVLCRIYKKNNSTASRHHHHLHHIHLDNDHHRHDMMIDDDRFRHVPPGLHFPAIFSDNNDPTAIYDGGGGGYGGGSYSMNHCFASGSKQEQLFPPVMMMTSLNQDSGIGSSSSPSKRFNGGGVGDCSTSMAATPLMQNQGGIYQLPGLNWYS

SEQ ID NO: 869 - DNA, 1137 bp, Arabidopsis thaliana
  G1517
atggaaccattcgttgttaaggagaacatcgtcgcatccgcttcttcgccgatgaagaagcgacggatcgatcacactgagtcagctgatggttctgcgattaacgcttctaactctagtagcatcggtggtaacgatacggtgatgaacatggcggagtttggtaacgacaactccaacaatcaggagtctcaacaagtttgcactttcttcaagaagccaacgaaaagtaaaaacataaggaaaagaaccattgacgctgatgaagaagacggagattcgaaaagcgaaagctctattttacaaaatctaaagaaagttgcaaaacccgatagcaacttgtacttttcttctggaccatctactagaacgagtggagctcctgagagacccgtttttcactacgattcatccaaggaaatccaggttcagaacgacagtggagcaacagcgacccttgaaactgaaaccgacttcaatcaagacgctcgagctatccgtgaaagagttcttaaaaaagcagaccatgcattgaaggggaataagaaaaaggcttcagatgagaagctgtacaaaggaattcatggatatacagatcacaaagctgggtttagaagagaacaaacaatctcgagcgagaaagctggaggctcacacgggcctttaagagcttctgctcacatcagagtatcggctagattcgattaccagccagacatttgcaaggattacaaggaaaccggatactgtggatatggagattcgtgtaagttcttgcatgaccgtggggattacaagccgggatggcagatagagaaagagtgggaagaggcagagaaagttaggaagagaaataaagctatgggagttgaggatgacgatgatgaggctgacaaggatagcgacgaagacgaaaatgcattgccctttgcttgcttcatttgcagggagccttttcttgatccagttgtcaccaaatgcaagcattacttctgtgagcattgtgctttaaagcatcacacgaagaacaagaaatgctttgtgtgtaaccaaccaacaatggggattttcaatgcagcacatgagatcaagaagagaatggctgaagaacggagtaaagctgaacaaggattgtga

SEQ ID NO: 870 - protein, 378 aa, Arabidopsis thaliana
  G1517 polypeptide
MEPFVVKENIVASASSPMKKRRIDHTESADGSAINASNSSSIGGNDTVMNMAEFGNDNSNNQESQQVCTFFKKPTKSKNIRKRTIDADEEDGDSKSESSILQNLKKVAKPDSNLYFSSGPSTRTSGAPERPVFHYDSSKEIQVQNDSGATATLETETDFNQDARAIRERVLKKADHALKGNKKKASDEKLYKGIHGYTDHKAGFRREQTISSEKAGGSHGPLRASAHIRVSARFDYQPDICKDYKETGYCGYGDSCKFLHDRGDYKPGWQIEKEWEEAEKVRKRNKAMGVEDDDDEADKDSDEDENALPFACFICREPFLDPVVTKCKHYFCEHCALKHHTKNKKCFVCNQPTMGIFNAAHEIKKRMAEERSKAEQGL

SEQ ID NO: 871 - DNA, 871 bp, Arabidopsis thaliana
  G1655
tttctaactagtcacattgagagagagagagagagaaagagagactctcagaatctgaagaagaagaagagattgttgtttttgccttttatcatcggtttctttgaatctctggttttaaatcggatttaatggtggagtctctgttcccgagcatcgaaaacacaggtgaatcgtctcgaagaaagaagccgaggatatcagagacggcggaggcggagatagaggcacgacgtgtcaacgaagaaagcttgaagagatggaaaacgaatcgtgtgcaacagatctacgcttgtaagctcgtcgaagctttacgccgagttcgtcagagatcttccaccaccagcaacaacgagaccgataaactcgtctccggcgcggcgagggagatacgtgatacggcggatcgagttctagctgcgtccgctcgtggtacgactcggtggagcagagcgattttagcgagtcgcgtccgagcgaagctgaagaaacatagaaaggcgaaaaagtcaacgggaaattgtaaatcgagaaaaggtctcacggagacgaatcggattaagttaccggcggttgagagaaaactgaagattcttggccgtttggttcctggttgccggaaagtctctgtaccgaatcttttagatgaagcgaccgattacatcgcagcgttagagatgcaggttcgagccatggaggctctcgccgaacttttaaccgcagccgcaccacggacgacgttgaccggaacttaacggcggcagttagtttgtcagttgttaattagcttttcttttacctttttacccctttattttggcttcaagtgttttttttttctcgtcgacgcgattttaatttattaaattca

SEQ ID NO: 872 - protein, 207 aa, Arabidopsis thaliana
  G1655 polypeptide
MVESLFPSIENTGESSRRKKPRISETAEAEIEARRVNEESLKRWKTNRVQQIYACKLVEALRRVRQRSSTTSNNETDKLVSGAAREIRDTADRVLAASARGTTRWSRAILASRVRAKLKKHRKAKKSTGNCKSRKGLTETNRIKLPAVERKLKILGRLVPGCRKVSVPNLLDEATDYIAALEMQVRAMEALAELLTAAAPRTTLTGT

SEQ ID NO: 873 - DNA, 529 bp, Arabidopsis thaliana
  G1743
tttctccatgggctttcccgtaggttacacagaggttttcttaccgaagcttttcgtacaaacgctttcgattctcggattcatcagaaccatcgtcttctctatcttccgcttcttgggtctctcagattttctcgaaatggatcaaacctggcccgattacacatcgtacccgacccgaatacccgaaacccgctcacctttctccgcactcctaattagagagatcctaccggttatcaaattcgaagagttaacgaattccggcgaagatctaccggaaaactgcgccgtttgtctatacgaattcgaaggagaacaagagatccggtggctgagaaattgcagacatatatttcaccggagctgtcttgaccgttggatggatcatgatcagaagacgtgtccactttgtagaacaccgtttgttccagatgagatgcaagaagagtttaatcaacggctatgggctgcttctggtgttcatgattttcactgtcccgtgaccgaattattatagaagaagcca

SEQ ID NO: 874 - protein, 170 aa, Arabidopsis thaliana
  G1743 polypeptide
MGFPVGYTEVFLPKLFVQTLSILGFIRTIVFSIFRFLGLSDFLEMDQTWPDYTSYPTRIPETRSPFSALLIREILPVIKFEELTNSGEDLPENCAVCLYEFEGEQEIRWLRNCRHIFHRSCLDRWMDHDQKTCPLCRTPFVPDEMQEEFNQRLWAASGVHDFHCPVTELL

SEQ ID NO: 875 - DNA, 578 bp, Arabidopsis thaliana
  G1789
caaggactctgcgacatctgtgcaacatatcatttcctcagaatctctttcttttctaggtttattactacacaaaaccaaacatcatcaactttagttactaaacaatggcatcaggctcaatgtcttcttatggctctggctcatggactgttaagcagaacaaagcctttgagcgtgctctagcagtctatgaccaagacactccggaccgttggcacaatgttgctagagctgttggtggtaaaacaccagaagaagctaagagacagtatgaccttctagttcgtgacatcgaaagcatcgagaatggtcacgtgccattccctgactacaagactactacaggaaacagcaacagaggcaggctgcgtgatgaggaaaagaggatgagaagcatgaagctgcagtgagacaagaagcaacaaaacctaactacgtatgatcgtcaaaataaaagagaatcacttcagagagatgtgtttttttcaatgtctgacgaatcaatgtttttttcttgcaatttctcatgtttttccctaagaaatggtttttttttcgaggcaacaaaaaaaaaa

SEQ ID NO: 876 - protein, 101 aa, Arabidopsis thaliana
  G1789 polypeptide
MASGSMSSYGSGSWTVKQNKAFERALAVYDQDTPDRWHNVARAVGGKTPEEAKRQYDLLVRDIESIENGHVPFPDYKTTTGNSNRGRLRDEEKRMRSMKLQ

SEQ ID NO: 877 - DNA, 1356 bp, Arabidopsis thaliana
  G1806
atgcagagcagcttcaaaaccgttcctttcactcctgatttctactctcaatcctcttacttcttcagaggagatagttgtcttgaggagtttcatcaaccagtcaatggttttcaccatgaagaagctatcgatttaagtccaaatgtcactattgcttcagctaacttacactacacgacgtttgatacggttatggattgtggtggtggtggtggtggcttgagggagagacttgaaggaggagaagaggagtgtttggacacagggcaattagtgtaccagaaagggacaagattagtaggaggaggagtaggagaagtgaacagcagttggtgtgattcggtttcagctatggctgataacagtcaacatactgacacttccacagatattgatactgatgacaagactcagttgaatggaggtcatcaagggatgctattggctacaaattgttcagatcaatccaatgtgaaatctagtgatcaaaggacacttcgtcgacttgctcagaaccgggaggctgctaggaaaagtcggttgaggaaaaaggcctatgttcagcaacttgagaatagtcgaatcaggcttgcacagctagaggaagagctcaaaagagctcgccaacagggatctttggttgaaagaggagtttcagcggatcacacgcatttggcagcaggaaatggtgtcttttcatttgaattggaatatacacgttggaaggaggaacatcaaagaatgatcaacgacttaagatcgggtgtgaattcgcagttaggtgacaacgatctacgcgttctagtggatgctgtgatgagtcactatgatgaaatattcaggctaaagggaattggcactaaagttgaagtctttcatatgctctcaggcatgtggaagacacctgccgagagatttttcatgtggttaggtggatttagatcatcagagttacttaagatattggggaaccatgtggatccattgacggaccagcagttgataggcatttgcaaccttcagcaatcgtctcaacaagcagaggatgcattgtcacaaggcatggaagctctacaacaatcacttctcgagacgctttcttctgcttctatgggtccaaactcttcagcaaatgttgcagattatatgggtcatatggctatggctatgggcaaacttggcactcttgaaaacttccttcgccaggctgatttattgaggcaacaaactctgcaacagcttcacagaattctcaccacacgacaagctgctcgcgcctttttggtcatccacgattatatttctcggcttagagcacttagctctctatggttagccagacctagagactaa

SEQ ID NO: 878 - protein, 451 aa, Arabidopsis thaliana
  G1806 polypeptide
MQSSFKTVPFTPDFYSQSSYFFRGDSCLEEFHQPVNGFHHEEAIDLSPNVTIASANLHYTTFDTVMDCGGGGGGLRERLEGGEEECLDTGQLVYQKGTRLVGGGVGEVNSSWCDSVSAMADNSQHTDTSTDIDTDDKTQLNGGHQGMLLATNCSDQSNVKSSDQRTLRRLAQNREAARKSRLRKKAYVQQLENSRIRLAQLEEELKRARQQGSLVERGVSADHTHLAAGNGVFSFELEYTRWKEEHQRMINDLRSGVNSQLGDNDLRVLVDAVMSHYDEIFRLKGIGTKVEVFHMLSGMWKTPAERFFMWLGGFRSSELLKILGNHVDPLTDQQLIGICNLQQSSQQAEDALSQGMEALQQSLLETLSSASMGPNSSANVADYMGHMAMAMGKLGTLENFLRQADLLRQQTLQQLHRILTTRQAARAFLVIHDYISRLRALSSLWLARPRD

SEQ ID NO: 879 - DNA, 294 bp, Arabidopsis thaliana
  G1911
atggcatcaagctcaatgtcttctcagagctctggctcgtggactgctaagcagaacaaagcctttgagcaggctctagcaacctatgaccaggacactcctaaccgttggcaaaatgttgccaaagtcgtgggtggaaaaacaacagaggaggtaaagagacactacgaactcttagtgcaagacatcaacagcatagagaacggtcatgttccattcccaaactacaggactagtggaggctgcactaatggcaggcttagtcaggaggaaaaaaggtatgtattgtcctaa

SEQ ID NO: 880 - protein, 97 aa, Arabidopsis thaliana
  G1911 polypeptide
MASSSMSSQSSGSWTAKQNKAFEQALATYDQDTPNRWQNVAKVVGGKTTEEVKRHYELLVQDINSIENGHVPFPNYRTSGGCTNGRLSQEEKRYVLS

SEQ ID NO: 881 - DNA, 1677 bp, Arabidopsis thaliana
  G2011
aatgtcggttgtacaattatttgtcactaaagtttccaaatttcttctaaactgatgaatcaatggaacatgatgacgaaaaagataaatccacggtggcgggaactgacccacccatttccaccgcctctctattccccagatttttttcaattatctgactacagtttgtcggttacttccttccctaaacctttataaaccattaaacctctcatccttcttctcttaaaccccctaattatcacacacaccccaatttctcactctctctctcactaaaacccgtaaattttctactatatcaaatgagcccaaaaaaagatgctgtttctaaaccaactccaatttcagtacccgtttcgagacgatccgatatacccgggtctctctacgtcgacactgacatgggtttctctgggtcaccacttcccatgccactagacatcttacaagggaatccaattccaccttttttatccaagacttttgatttggttgatgacccgactcttgacccggtcatctcttggggactgaccggagctagcttcgtagtttgggatcctctagagtttgccagaatcatacttccaaggaatttcaaacacaacaatttctccagcttcgtcagacagcttaacacttatggatttcgaaagattgatactgacaagtgggaattcgctaacgaggctttccttagaggcaagaagcatcttctgaagaacattcatcgtcgtcgatcaccacaatccaaccaaacttgctgcagtagcactagccaaagccaagggtcacctactgaggttggaggagagattgagaagctgaggaaagagcggcgtgcattgatggaggaaatggttgagcttcagcagcaaagcagaggcacagctcgacatgtggacactgtaaaccagaggctgaaagctgcagagcaacgtcagaagcaattgctctctttcttggctaagttgtttcagaaccggggtttcttggaacgcctgaagaacttcaaaggaaaagaaaaaggaggagctcttggattggaaaaggcgagaaagaagttcatcaagcaccaccagcagcctcaagattctccaacaggaggggaggtggtgaagtatgaagctgatgattgggagagattgctaatgtatgacgaagagactgagaacaccaagggtttaggagggatgacttcaagcgatccaaaaggcaagaacttgatgtatccatcagaagaagagatgagcaaaccagattacttgatgtccttcccatctcctgaaggacttattaaacaagaagagacgacatggagcatgggtttcgatactacaataccgagtttcagcaacaccgatgcatggggaaacacaatggactataatgatgtctcagagtttggttttgctgcagaaacaacaagtgatggtttgcctgatgtctgctgggaacaatttgctgcaggaatcacagagactggattcaactggccaactggtgatgatgatgataatacgccaatgaatgatccttaggatcttttcatatatagtttagaccaaaaacccgtttcttatcgggtgaactattaattcattattcattttgaatgcactctttatacatatatataatattgatgagtttgattgttccaaaaaaaaa

SEQ ID NO: 882 - protein, 412 aa, Arabidopsis thaliana
  G2011 polypeptide
MSPKKDAVSKPTPISVPVSRRSDIPGSLYVDTDMGFSGSPLPMPLDILQGNPIPPFLSKTFDLVDDPTLDPVISWGLTGASFVVWDPLEFARIILPRNFKHNNFSSFVRQLNTYGFRKIDTDKWEFANEAFLRGKKHLLKNIHRRRSPQSNQTCCSSTSQSQGSPTEVGGEIEKLRKERRALMEEMVELQQQSRGTARHVDTVNQRLKAAEQRQKQLLSFLAKLFQNRGFLERLKNFKGKEKGGALGLEKARKKFIKHHQQPQDSPTGGEVVKYEADDWERLLMYDEETENTKGLGGMTSSDPKGKNLMYPSEEEMSKPDYLMSFPSPEGLIKQEETTWSMGFDTTIPSFSNTDAWGNTMDYNDVSEFGFAAETTSDGLPDVCWEQFAAGITETGFNWPTGDDDDNTPMNDP

SEQ ID NO: 883 - DNA, 897 bp, Arabidopsis thaliana
  G2215
atggctgatcacacaaccaaagaacagaagtcattctcattcctagctcattctccatcctttgatcacagctccttaagttatcctttattcgactgggaagaagatcttcttgctctccaagaaaactctggctctcaagcatttccttttactacaacttctctgcctttacctgatcttgaacccttgtctgaagatgtactcaattcatacagctctgcgtcatggaacgaaacagagcaaaacagaggagatggcgcttcatcggagaagaagagggaaaatggaacagtgaaagagacaactaagaagaggaaaatcaatgagagacacagagaacatagcgtgagaatcatcagcgatattactacctacacaactagttcagctccaacgacattgtcaaaggaaactgtctctcgctacttctacatgcccataactcaggctgcaatagcacttaacgttggtttaactctactaaaaaggagatgtcgcgaattgggtattcgccgatggcctcatcgtaaacttatgagcttaaacactttgatcagtaacgtcaaggagctgcagaagatggaaggcgaagagaatgcagaaaaactgcaggacgcgttggagatgcttgagaaggagaagaggacaattgaggatttgccggatttggagtttaaggacaagacaaagaggctaagacaagcttgtttcaaggctaaccacaagaggaagaagaagagaagtctcaagtccgatcagtctcaagtaccctcgtgttcaagcagcggatcagttcctagtgatgagtcggttgatgaagcaggaatggagagtgatgaagaaatgaagtatctcttgtgtggtttctcaagtgaatttactagtggtttgtga

SEQ ID NO: 884 - protein, 298 aa, Arabidopsis thaliana
  G2215 polypeptide
MADHTTKEQKSFSFLAHSPSFDHSSLSYPLFDWEEDLLALQENSGSQAFPFTTTSLPLPDLEPLSEDVLNSYSSASWNETEQNRGDGASSEKKRENGTVKETTKKRKINERHREHSVRIISDITTYTTSSAPTTLSKETVSRYFYMPITQAAIALNVGLTLLKRRCRELGIRRWPHRKLMSLNTLISNVKELQKMEGEENAEKLQDALEMLEKEKRTIEDLPDLEFKDKTKRLRQACFKANHKRKKKRSLKSDQSQVPSCSSSGSVPSDESVDEAGMESDEEMKYLLCGFSSEFTSGL

SEQ ID NO: 885 - DNA, 804 bp, Arabidopsis thaliana
  G2452
atgtcatcgtcgacgatgtacagaggagttaatatgttttcaccggcaaacacaaactggatttttcaagaagtcagagaagccacgtggacggcggaggagaacaaacggttcgagaaagctctcgcttatctggacgacaaagacaatcttgagagctggtccaagatcgcagatttgattcccggcaaaacagtagctgacgtcattaaacgatacaaggagctagaggatgatgtcagcgacatcgaagccggacttatccccattccgggatacggcggcgacgcctcctccgctgcaaacagtgactatttctttggtctagaaaactccagctacggttatgattacgtcgttggaggaaagaggagttcgccggcgatgactgattgttttaggtctccgatgccggaaaaggagaggaagaaaggagttccgtggaccgaggacgaacacctacgatttctgatgggtttgaagaaatatggaaaaggagattggagaaacatagcaaaaagctttgtgacgactcgaacgccgacgcaagtcgcttcacacgctcagaaatattttcttcgacaactcacagatggtaaagacaaaagacgatcaagtattcacgatatcaccactgttaacatccctgacgcagacgcatccgcaaccgccacgaccgctgacgtagcactctctcctactccagccaattcttttgacgttttccttcagccaaatcctcattacagtttcgcgtctgcgtctgcgtctagctattataatgcgtttccgcagtggagttaa

SEQ ID NO: 886 - protein, 267 aa, Arabidopsis thaliana
  G2452 polypeptide
MSSSTMYRGVNMFSPANTNWIFQEVREATWTAEENKRFEKALAYLDDKDNLESWSKIADLIPGKTVADVIKRYKELEDDVSDIEAGLIPIPGYGGDASSAANSDYFFGLENSSYGYDYVVGGKRSSPAMTDCFRSPMPEKERKKGVPWTEDEHLRFLMGLKKYGKGDWRNIAKSFVTTRTPTQVASHAQKYFLRQLTDGKDKRRSSIHDITTVNIPDADASATATTADVALSPTPANSFDVFLQPNPHYSFASASASSYYNAFPQWS

SEQ ID NO: 887 - DNA, 758 bp, Arabidopsis thaliana
  G2455
tcattgggataactaaaagtttcaagaagagaaacatatcattgaagagagaacccacacaaaaaaaaatgtctgtagatttctcatctgagcgtgtttgctatgtccactgcagcttctgcaccacgattttagcggtaagtgtaccatacgcaagtttgttcacacttgtgacggtgagatgtggccattgtaccaatttgctatccctcaacattggagtttcacttcatcaaacctcagctcctcccattcaccaagatcttcagcctcatagacagcacacaacctctctggtgacaaggaaagattgtgcatcgtcttctaggagcaccaacaatttatcggaaaacattgatcgtgaggctcctagaatgcctcctattcgcccaccggagaaaagacaacgtgttccttcggcctacaacagattcatcaaggaggaaatccaaaggattaaggcttgcaatccagagattagccaccgtgaggcatttagcactgctgctaaaaattgggcacattttcctcacattcactttggattaaagctggatggcaacaagaaaggcaagcaattagaccagtcagttgcaggccaaaagtctaatggctattactaaagcctttatatatatacacacatatatacacttatacgtatatatatgtgtatagatatatatgcgtgtgtatgatttatgtttatctttgtacgtacgcattaatgaatgtgtaagcagagagctgatgatgga

SEQ ID NO: 888 - protein, 184 aa, Arabidopsis thaliana
  G2455 polypeptide
MSVDFSSERVCYVHCSFCTTILAVSVPYASLFTLVTVRCGHCTNLLSLNIGVSLHQTSAPPIHQDLQPHRQHTTSLVTRKDCASSSRSTNNLSENIDREAPRMPPIRPPEKRQRVPSAYNRFIKEEIQRIKACNPEISHREAFSTAAKNWAHFPHIHFGLKLDGNKKGKQLDQSVAGQKSNGYY

SEQ ID NO: 889 - DNA, 867 bp, Arabidopsis thaliana
  G2510
ataacaaactctttaatgtcaccacagagaatgaagctatcatcaccaccagttaccaacaacgaaccaaccgccaccgcttctgccgttaaatcttgcggcggaggaggtaaagaaaccagctcatcgaccacgaggcatccagtgtaccacggagttcgcaaacgccgatggggaaaatgggtttctgagatcagagagccccggaaaaagtctcggatttggctcggatcttttccggtgccggagatggctgctaaggcctacgacgtggcagcgttttgtctaaaaggtagaaaagctcagctgaatttccctgaagaaatcgaggatctacctcgaccgtccacgtgtactcccagagatatccaagtcgcagcggccaaagcagccaacgccgtgaagatcatcaaaatgggagatgatgacgtggcaggaatagacgacggagatgatttctgggaaggcattgagctgcctgagcttatgatgagtggaggtgggtggtcgccggagccttttgttgccggagatgatgccacgtggcttgtcgacggagacttgtatcagtatcagttcatggcgtgtctgtgagtgttgctgtcgattgtgtcgtattcgttatacgtgtacgttgtatcgttattgtgttggctcacttaatttaatgcatatgcatgtatattttcatttatttgtttctagtttattgttttacgcgattaataattagatacctgtttctcaagttagttatcaggtttgtacgcatctacaaaaatacgtataagtgtatgttcttatatacagtttttgtttgcataagtattgctacttattctaaaaaaaaaaaaaaaaaaaaaaaaa

SEQ ID NO: 890 - protein, 192 aa, Arabidopsis thaliana
  G2510 polypeptide
MSPQRMKLSSPPVTNNEPTATASAVKSCGGGGKETSSSTTRHPVYHGVRKRRWGKWVSEIREPRKKSRIWLGSFPVPEMAAKAYDVAAFCLKGRKAQLNFPEEIEDLPRPSTCTPRDIQVAAAKAANAVKIIKMGDDDVAGIDDGDDFWEGIELPELMMSGGGWSPEPFVAGDDATWLVDGDLYQYQFMACL

SEQ ID NO: 891 - DNA, 786 bp, Arabidopsis thaliana
  G2515
atgggaagaggaagggttcagctacggcggatcgagaataagataaggagacaagtgacattttcaaagcgaaggaccggtttggtaaagaaagctcaagagatctcagtgttatgtgatgctgaagttgctttgattgttttctcccccaaaggcaaactctttgagtactctgctggttccagcatggagagaattcttgatcgatatgagaggtctgcctacgccggtcaagatattcctacaccaaatttggattcacagggagagtgctcaacagaatgttcaaagctcttgaggatgattgatgtcctgcaaagaagcctgaggcacttaagaggagaagaggtggatggtctaagtatcagagaccttcaaggtgtggagatgcaacttgatactgccctcaagaaaactcgctctagaaagaaccagctcatggtagagtccatagcacagcttcagaaaaaggagaaggaactaaaagaactgaagaaacagctaacaaagaaggctggtgaaagggaagactttcaaacgcaaaacctcagccatgacttagcctccttggcaacaccgccatttgaatcaccccatgagcttcgccggacaatatctcctcctcctcctcctttatcttcgggggatacatcacaaagggatggagttggagaagtagctgccggaaccctaattcgaaggacgaatgcaacgttgcctcattggatgccccagctcaccggagaatagaggtccgaaacaatcttggttttttaaatttttctg

SEQ ID NO: 892 - protein, 249 aa, Arabidopsis thaliana
  G2515 polypeptide
MGRGRVQLRRIENKIRRQVTFSKRRTGLVKKAQEISVLCDAEVALIVFSPKGKLFEYSAGSSMERILDRYERSAYAGQDIPTPNLDSQGECSTECSKLLRMIDVLQRSLRHLRGEEVDGLSIRDLQGVEMQLDTALKKTRSRKNQLMVESIAQLQKKEKELKELKKQLTKKAGEREDFQTQNLSHDLASLATPPFESPHELRRTISPPPPPLSSGDTSQRDGVGEVAAGTLIRRTNATLPHWMPQLTGE

SEQ ID NO: 893 - DNA, 1193 bp, Arabidopsis thaliana
  G2571
attaaatagatctttaaacaaaaaaaccaaattctacttttctttcaaaaacaatctctcattatctcaatcttactcttgttcaatctcttttgaacttgaaaaaccatcattctatcaaatcaaacacaattgttagggtttctttttatcttatactccacgaaacgtctggttgagaaaaaatggaagaaagcaatgatatttttcagaacaatttcagtcctaaaatctcagaaatcagagcatctctgtctcagatcatattagcaggaggaccaaacacactcgactcaatcttctcacttctcactccctcctccgtagaatccgccacaacatcattcaacactcacaatcctccgccaccgccgcagctcgggtcctccgtctatctccgccaacgagatatcatcgagaagttccaccttcagaacagagcaatctccactcctcatcctcctctgttttcctcaacgtacgatcatcatcaaacttccgagctaatgctccaagcggcggccgggtctccagccgccgctttcgccgctgcgttagcggctgggagggtgacgaaaaagaagaaactttacagaggagtgaggcagagacattggggaaaatgggttgcggagataagattgccgcaaaacagaatgagggtttggttaggtacttacgacacggcggaagccgccgcttacgcttacgatcgcgccgcctataagctccgtggagaatacgctcgtctcaattttcctaatctcaaagacccgagtgagctactcggactcggagattcctctaagctaatagctctcaagaacgccgtcgacgggaagatccaatccatttgccagagagtcagaaaagagagagcaaaaaagagcgtaaaagtgagcaaaaactcgtcggccacggcggattcttcgtgtttgtcatcgccggagattctgtcgtcgtctccggtgacgacaactactactgcggttacttcagaggatagttattgggtttcacctatgggtttgtgtaacagtgaaaatagttctccggtatcagtttcggtccctagtgaagtaccggcgacggcggaggaagaggcaatgatgggagtggacactgatgggtttttattagcgaggatgccatcgttcgatccagagctgatttgggaagttcttgccaattaa

SEQ ID NO: 894 - protein, 335 aa, Arabidopsis thaliana
  G2571 polypeptide
MEESNDIFQNNFSPKISEIRASLSQIILAGGPNTLDSIFSLLTPSSVESATTSFNTHNPPPPPQLGSSVYLRQRDIIEKFHLQNRAISTPHPPLFSSTYDHHQTSELMLQAAAGSPAAAFAAALAAGRVTKKKKLYRGVRQRHWGKWVAEIRLPQNRMRVWLGTYDTAEAAAYAYDRAAYKLRGEYARLNFPNLKDPSELLGLGDSSKLIALKNAVDGKIQSICQRVRKERAKKSVKVSKNSSATADSSCLSSPEILSSSPVTTTTTAVTSEDSYWVSPMGLCNSENSSPVSVSVPSEVPATAEEEAMMGVDTDGFLLARMPSFDPELIWEVLAN

SEQ ID NO: 895 - DNA, 1032 bp, Arabidopsis thaliana
  G2702
atgatgatgaggaaaccggacattactacgatcagagacaaaggcaagccaaatcatgcatgtggtggtaataacaacaaaccgaagctaagaaaaggactttggtcgcctgatgaagatgagaagctgataagatacatgttgactaatggacaaggatgttggagtgacatcgctagaaatgctggtcttttacgttgtggtaaaagttgtcgccttcgctggatcaattacttgaggcctgatcttaaacgtggatccttctctcctcaggaggaggatctcatcttccatttgcattccattcttggtaacaggtggtctcaaatagctactcggcttccaggtagaacagacaacgagatcaaaaacttttggaactcgacattgaagaagcggcttaagaacaacagcaacaacaatacttcatcaggatcatcacctaacaatagtaatagtaattccttggacccaagagatcaacatgtggatatgggaggcaactcaacttcattgatggatgactatcatcatgatgaaaacatgatgacagtggggaacaccatgcgcatggactcttcctccccattcaatgttggaccaatggttaatagtgtgggcttaaaccaactttatgatcccttgatgatatcagtgccggataacggatatcaccaaatgggaaacacagtgaatgtgttcagcgttaatggtttaggagattatggaaacacaattcttgatccaattagcaagagagtatcagtagaaggtgatgattggttcattcccccctcggagaataccaacgtcattgcttgtagtacaagcaacaacctaaacttacaggcccttgatccttgcttcaatagcaaaaatctttgtcattcagaaagcttcaaggtagggaatgtgttggggatagagaatggttcttgggaaatagaaaaccctaaaatcggagattgggatttggatggtctcatcgataacaactcttcttttcccttccttgatttccaagtcgattga

SEQ ID NO: 896 - protein, 343 aa, Arabidopsis thaliana
  G2702 polypeptide
MMMRKPDITTIRDKGKPNHACGGNNNKPKLRKGLWSPDEDEKLIRYMLTNGQGCWSDIARNAGLLRCGKSCRLRWINYLRPDLKRGSFSPQEEDLIFHLHSILGNRWSQIATRLPGRTDNEIKNFWNSTLKKRLKNNSNNNTSSGSSPNNSNSNSLDPRDQHVDMGGNSTSLMDDYHHDENMMTVGNTMRMDSSSPFNVGPMVNSVGLNQLYDPLMISVPDNGYHQMGNTVNVFSVNGLGDYGNTILDPISKRVSVEGDDWFIPPSENTNVIACSTSNNLNLQALDPCFNSKNLCHSESFKVGNVLGIENGSWEIENPKIGDWDLDGLIDNNSSFPFLDFQVD

SEQ ID NO: 897 - DNA, 1025 bp, Arabidopsis thaliana
  G2763
aaaggaagaagaagaagaagaaaggattcgtcttccttcttccacaccctttctgacacctcatctcccctcccaccttctccgtcccgttccgtttctccatcagatcctcgattccgatccaacagttcgaattcagtttccgattctgatctgatcgaaccaatactcactgagatttgatcggcgattatggagtctatatctccggtatcgaatcagcttcttcagccgacgacgacgagctctaattccgatcgctctcgtcgtaagcgtaagaagaaatcatcgccatcatcggttgagaaatctccatctccgtcaatatcgttggagaaatggagatcggagaagcagcaacagatctactcaacgaagctagttcatgctttaagagagctacgaatcagccaacaaccatcttcatcatcatcttcttcgattccacgtggaggtagagccgtacgtgaagtcgccgatagagctttagcagttgcggcgagaggtaaaacgttatggagtcgagcgatactttcaaaagctgtaaaactcaaattcaggaaacacaaacgccagagaatctctaatccgacgacgacgacgttaaccaccgggagtatcaggtcaaagaaacagagagcgacggttttgaggcttaaggctaaaggtttgccagctgtacagaggaaagtgaaagtactgagccggttagttcccggttgccgtaaacaatcattaccggtggttttagaagaaaccactgattatatagctgcgatggagatgcagattcgtactatgactgcgattctctccgccgttagttcttctcctccgccgccaacgccaggtcacgaagggggacaaacacacatgcttggttagttggccaaactgtccttttatttttttccaattttaaaaaccaaaaaaaaaactgtttttttttatcatattattattcttctcactgtattgtttgttgtttgaatattttactattcaactttatttaccatttcgtc

SEQ ID NO: 898 - protein, 230 aa, Arabidopsis thaliana
  G2763 polypeptide
MESISPVSNQLLQPTTTSSNSDRSRRKRKKKSSPSSVEKSPSPSISLEKWRSEKQQQIYSTKLVHALRELRISQQPSSSSSSSIPRGGRAVREVADRALAVAARGKTLWSRAILSKAVKLKFRKHKRQRISNPTTTTLTTGSIRSKKQRATVLRLKAKGLPAVQRKVKVLSRLVPGCRKQSLPVVLEETTDYIAAMEMQIRTMTAILSAVSSSPPPPTPGHEGGQTHMLG

SEQ ID NO: 899 - DNA, 1089 bp, Arabidopsis thaliana
  G2774
atgcaacttcgacattaaattccaaagtaaactacacaattaagaacatgacggaagagtttgagatcgcaggaatctccaccggagcttggtggagctcgccaacaaacaccgccgcagtattctctggctactcgctgccatgttccactgagattagccctgatgtcacaaatttcggatggcaaaacttcgataacaagattaacgatcataatgatggttgtatgaacatgcataatagtttcttcgaaggactattaatcgatcctaacgatcaattactaccggatccatggtccaaaagtacaattcctaacgctaaatctgagctccttgaaaacttcccattcttagataacatgttcttggtcgattcagaagctgaatctttgttggatcatgaaatcagaaaccataagtcgtctaaggagcaaattacacaagactacaagaatcttacttcaaaggcacaattagaagagaacagcgatgagtattcaccgcgattactaaaaagaccgagactcgagacactatctccattgccaagcttcaaagttcgtaaagaaaaactcggagatagaatcactgcgcttcagcaactggtttctccatttggcaagacagatacagcttctgttctcaacgaagctgtagagtacataaagtttcttcaagaacaagtcactgtattgagtaatccagaacagaacaccataggatctgttcaacaacagcagtgttcaaacaagaaatctatcaatactcaaggagaagtagaagaagacgaatgtagtccaagaagatatgtagatctttcgagccgtggactatgtctaatgccgatctcagcttcatatcccgtggctgcagctgcggcttcggctgcagagatgaacgtacatctggtttctggcatcttccattctttgtaaacttataaactaaatacgtagatacataaacaaacaaagtaatcttccgcaaacaggggatcttgtaaagttttatgtccctttttaatttatacagaaatgtaaatgtcctgtaatacttcaaaatcatatattgtttgtttgcgtacgt

SEQ ID NO: 900 - protein, 296 aa, Arabidopsis thaliana
  G2774 polypeptide
MTEEFEIAGISTGAWWSSPTNTAAVFSGYSLPCSTEISPDVTNFGWQNFDNKINDHNDGCMNMHNSFFEGLLIDPNDQLLPDPWSKSTIPNAKSELLENFPFLDNMFLVDSEAESLLDHEIRNHKSSKEQITQDYKNLTSKAQLEENSDEYSPRLLKRPRLETLSPLPSFKVRKEKLGDRITALQQLVSPFGKTDTASVLNEAVEYIKFLQEQVTVLSNPEQNTIGSVQQQQCSNKKSINTQGEVEEDECSPRRYVDLSSRGLCLMPISASYPVAAAAASAAEMNVHLVSGIFHSL

SEQ ID NO: 901 - DNA, 1089 bp, Arabidopsis thaliana
  G2888
atggagctgacgcaacccataagagaaaacggagacccgcagggacaccagctaacagatccagatgcagaggtggtatctttgtcaccaagaacgttactagaatcagatcggtacgtgtgtgagatctgcaaccaagggtttcagagagatcagaatctacagatgcatagaagacgacataaagtgccatggaagcttctgaagagagacaagaaggatgaggaagtgaggaagagagtctacgtgtgtcctgagccaacatgtctccaccatgacccgtgccacgctcttggagatctggtcggaatcaaaaagcacttccgccgtaaacacagtgtccacaagcaatgggtttgcgagagatgctccaaaggctatgcagttcaatctgactacaaagcccatctcaagacctgcggttcacgcggtcactcctgcgactgtggccgcgttttctccagggttgagagtttcatagagcatcaagatacttgcaccatccggcaacctcaacccaccaaccaccgtcatctacagcagcacacgatgggccttgacgctccatcaagaaccacttcgacagcaagcttcggccctttattgcatggacttcctttgttaagacctccacgaccgtccaatcaacattcaccagcttttgcttaccctttcaatgcttcatcagctcctttcgaaagcctcgaacttcaactatccataggaatggcaagaacatcagcacaagcgaggcacaacgaaaagagagagacgagtttaacaaaggagagagcgaacgaggaggcaaggaaggcagaggaaacgagacaagaagcgaaaaggcagatagagatggcagaaaaggattttgagaaagctaagagaataagggaagaagcaaaaaccgagttggagaaggctcacgttgttagagaagaagcaatcaagaggattaatgcaacaatgatggagatcacttgccactcttgcaagcaactatttcagctgcctgttacggctgatgagagtacgtcgtctcttgttatgagttacgtttcctcggcgacaactgaaggagaatgcgagtga

SEQ ID NO: 902 - protein, 362 aa, Arabidopsis thaliana
  G2888 polypeptide
MELTQPIRENGDPQGHQLTDPDAEVVSLSPRTLLESDRYVCEICNQGFQRDQNLQMHRRRHKVPWKLLKRDKKDEEVRKRVYVCPEPTCLHHDPCHALGDLVGIKKHFRRKHSVHKQWVCERCSKGYAVQSDYKAHLKTCGSRGHSCDCGRVFSRVESFIEHQDTCTIRQPQPTNHRHLQQHTMGLDAPSRTTSTASFGPLLHGLPLLRPPRPSNQHSPAFAYPFNASSAPFESLELQLSIGMARTSAQARHNEKRETSLTKERANEEARKAEETRQEAKRQIEMAEKDFEKAKRIREEAKTELEKAHVVREEAIKRINATMMEITCHSCKQLFQLPVTADESTSSLVMSYVSSATTEGECE

SEQ ID NO: 903 - DNA, 540 bp, Arabidopsis thaliana
  G2958
atgtcaccggaggaatacgttagggtttggccggattccggtgatcttggaggaactgagctgaccctagctttgcctggcactccgacaaatgcatcggaaggtccaaaaaagttcgggaacaaacgtagattcctcgagaccgttgatttaaaactcggggaagcacacgagaacaattatatctcaagcatggtcactaatgaccagttggtgggctggccgccggtagcgacagcgaggaaaacagtgaggcggaaatacgtgaaagtggcgttggatggtgcggcctatctcagaaaggttgatcttgggatgtacgattgctatggacagcttttcaccgctctagaaaacatgtttcaggggataataacaatatgtagagtgacagagttggagaggaagggagagtttgttgctacttacgaggataaggacggtgacttgatgttagtcggagatgtgccgtggatgatgtttgtggaatcttgcaaacgtatgaggttaatgaaaaccggagatgctattggattatag

SEQ ID NO: 904 - protein, 179 aa, Arabidopsis thaliana
  G2958 polypeptide
MSPEEYVRVWPDSGDLGGTELTLALPGTPTNASEGPKKFGNKRRFLETVDLKLGEAHENNYISSMVTNDQLVGWPPVATARKTVRRKYVKVALDGAAYLRKVDLGMYDCYGQLFTALENMFQGIITICRVTELERKGEFVATYEDKDGDLMLVGDVPWMMFVESCKRMRLMKTGDAIGL

SEQ ID NO: 905 - DNA, 1699 bp, Arabidopsis thaliana
  G5
ttttttttttgcaatctccccctaatctgttgtttctcgcttcttcttctgttaatcatctgtctttcaaaaagaaagaaaaaagaaaaattcgatttctgggtttgtttttgtcatacagaaaaaaatcaagcttatgaatttgtgtttaattttttgttttaatttgaaaggcaggttttttcagaacgagatcgttttttcaaatttcttctgattttacctctttttttcttcttagattttagtgaatcgagggtgaaatttttgattccctcttttcggatctacacagaggttgcttatttcaaaccttttagatccatttttttttaattttctcggaaaaatccctgtttctttacttttttataagtctcaggttcaattttttcggattcaaatttttattttaaatggcagctgctatgaatttgtacacttgtagcagatcgtttcaagactctggtggtgaactcatggacgcgcttgtaccttttatcaaaagcgtttccgattctccttcttcttcttctgcagcgtctgcgtctgcgtttcttcacccctctgcgttttctctccctcctctccccggttattacccggattcaacgttcttgacccaaccgttttcatacgggtcggatcttcaacaaaccgggtcattaatcggactcaacaacctctcttcttctcagatccaccagatccagtctcagatccatcatcctcttcctccgacgcatcacaacaacaacaactctttctcgaatcttctcagcccaaagccgttactgatgaagcaatctggagtcgctggatcttgtttcgcttacggttcaggtgttccttcgaagccgacgaagctttacagaggtgtgaggcaacgtcactggggaaaatgggtggctgagatccgtttgccgagaaatcggactcgtctctggcttgggacttttgacacggcggaggaagctgcgttggcctatgataaggcggcgtacaagctgcgcggcgatttcgcccggcttaacttccctaacctacgtcataacggatttcacatcggaggcgatttcggtgaatataaacctcttcactcctcagtcgacgctaagcttgaagctatttgtaaaagcatggcggagactcagaaacaggacaaatcgacgaaatcatcgaagaaacgtgagaagaaggtttcgtcgccagatctatcggagaaagtgaaggcggaggagaattcggtttcgatcggtggatctccaccggtgacggagtttgaagagtccaccgctggatcttcgccgttgtcggacttgacgttcgctgacccggaggagccgccgcagtggaacgagacgttctcgttggagaagtatccgtcgtacgagatcgattgggattcgattctagcttaggggcaaaataggaaattcagccgcttgcaatggagtttttgtgaaattgcatgactggcccaagagtaattaattaaatatggattagtgttaaatttcgtatgttaatatttgtattatggtttgtattagtctctctgtgtcggtccagcttgcggttttttgtcaggctcgaccatgccacagttttcattttatgtaatctttttttcttttgtcttatgtaatttgtagcttcagtttcttcatctataatgcaattttattatgattatgtg

SEQ ID NO: 906 - protein, 334 aa, Arabidopsis thaliana
  G5 polypeptide
MAAAMNLYTCSRSFQDSGGELMDALVPFIKSVSDSPSSSSAASASAFLHPSAFSLPPLPGYYPDSTFLTQPFSYGSDLQQTGSLIGLNNLSSSQIHQIQSQIHHPLPPTHHNNNNSFSNLLSPKPLLMKQSGVAGSCFAYGSGVPSKPTKLYRGVRQRHWGKWVAEIRLPRNRTRLWLGTFDTAEEAALAYDKAAYKLRGDFARLNFPNLRHNGFHIGGDFGEYKPLHSSVDAKLEAICKSMAETQKQDKSTKSSKKREKKVSSPDLSEKVKAEENSVSIGGSPPVTEFEESTAGSSPLSDLTFADPEEPPQWNETFSLEKYPSYEIDWDSILA

SEQ ID NO: 907 - DNA, 825 bp, Arabidopsis thaliana
  G197
atgggaaggtctccttgctgtgagaaagaccacacaaacaaaggagcttggactaaggaagaagacgataagctcatctcttacatcaaagctcacggtgaaggttgttggcgttctcttcctagatccgccggtcttcaacgttgcggaaaaagctgtcgtctccgatggattaactatctccgacctgatctcaagaggggtaacttcaccctcgaagaagatgatctcatcatcaaactacatagccttctcggtaacaagtggtctcttattgcgacgagattaccaggaagaacagataacgagattaagaattactggaacacacatgttaagaggaagctattaagaaaagggattgatccggcgactcatcgacctatcaacgagaccaaaacttctcaagattcgtctgattctagtaaaacagaggaccctcttgtcaagattctctcttttggtcctcagctggagaaaatagcaaatttcggggacgagagaattcaaaagagagttgagtactcagttgttgaagaaagatgtctggacttgaatcttgagcttaggatcagtccaccatggcaagacaagctccatgatgagaggaacctaaggtttgggagagtgaagtataggtgcagtgcgtgccgttttggattcgggaacggcaaggagtgtagctgtaataatgtgaaatgtcaaacagaggacagtagtagcagcagttattcttcaaccgacattagtagtagcattggttatgacttcttgggtctaaacaacactagggttttggattttagcactttggaaatgaaatga

SEQ ID NO: 908 - protein, 274 aa, Arabidopsis thaliana
  G197 polypeptide
MGRSPCCEKDHTNKGAWTKEEDDKLISYIKAHGEGCWRSLPRSAGLQRCGKSCRLRWINYLRPDLKRGNFTLEEDDLIIKLHSLLGNKWSLIATRLPGRTDNEIKNYWNTHVKRKLLRKGIDPATHRPINETKTSQDSSDSSKTEDPLVKILSFGPQLEKIANFGDERIQKRVEYSVVEERCLDLNLELRISPPWQDKLHDERNLRFGRVKYRCSACRFGFGNGKECSCNNVKCQTEDSSSSSYSSTDISSSIGYDFLGLNNTRVLDFSTLEMK

SEQ ID NO: 909 - DNA, 1107 bp, Arabidopsis thaliana
  G207
aaaagatctgtttcaatggcggatcgtgttaaaggtccatggagtcaagaagaagatgagcagctacgaaggatggttgagaaatacggaccgaggaattggtctgcgattagcaaatcgattccaggtcgatctggtaaatcgtgtagattacgttggtgtaatcagttatctccggaggttgagcatcgtcctttctcgccggaggaagatgagactattgtaaccgcccgtgctcagtttggtaacaagtgggcgacgattgctcgtcttcttaacggtcgtacggataacgccgttaaaaatcactggaactctacgcttaagaggaaatgcagcggaggtgtggcggttacgacggtgacggagacggaggaagatcaggatcggccgaagaagaggagatctgttagctttgatcctgcttttgctccggtggatactggattgtacatgagtcctgagagtcctaacggaatcgatgttagtgattctagcacgattccgtcaccgtcgtctcctgttgctcagctgtttaaaccaatgccgatttccggcggttttacggtggttccgcagccgttaccggttgaaatgtcttcgtcttcggaggatccacctacttcgttgagtttgtcactacctggagctgagaacacgagttcgagccataacaataacaacaacgcgttgatgtttccgagatttgagagtcagatgaagattaatgtagaggagagaggaggaggaggagaaggacgtagaggtgagtttatgacggtggtgcaggagatgataaaagctgaagtgaggagttacatggcggaaatgcagaaaacaagtggtggattcgtcgtcggaggtttatacgaatccggcggcaatggtggttttagggattgtggagtaataacacctaaggttgagtagttttggtttagggttaaaacttgaatcgattggggattttcaagagcattcatttttggggtttatggtaaaattaaaaacaaaaacaaaatgtacagaggaattaaaatttctatggaataatcttaaatctcaaatatttgttacttgttttggtgattcataaccaaaatcaaa

SEQ ID NO: 910 - protein, 304 aa, Arabidopsis thaliana
  G207 polypeptide
MADRVKGPWSQEEDEQLRRMVEKYGPRNWSAISKSIPGRSGKSCRLRWCNQLSPEVEHRPFSPEEDETIVTARAQFGNKWATIARLLNGRTDNAVKNHWNSTLKRKCSGGVAVTTVTETEEDQDRPKKRRSVSFDPAFAPVDTGLYMSPESPNGIDVSDSSTIPSPSSPVAQLFKPMPISGGFTVVPQPLPVEMSSSSEDPPTSLSLSLPGAENTSSSHNNNNNALMFPRFESQMKINVEERGGGGEGRRGEFMTVVQEMIKAEVRSYMAEMQKTSGGFVVGGLYESGGNGGFRDCGVITPKVE

SEQ ID NO: 911 - DNA, 989 bp, Arabidopsis thaliana
  G227
gtaccgtcgacgatccggcgatgtcaaacccgacccgtaagaatatggagaggattaaaggtccatggagtccagaagaagatgatctgttgcagaggcttgttcagaaacatggtccgaggaactggtctttgattagcaaatcaatccctggacgttccggcaaatcttgtcgtctccggtggtgtaaccagctatctccggaggtagagcaccgtgctttttcgcaggaagaagacgagacgattattcgagctcacgctcggtttggtaacaagtgggctacgatctctcgtcttctcaatggacgaaccgataacgctatcaagaatcattggaactcgacgctgaagcgaaaatgcagcgtcgaagggcaaagttgtgattttggtggtaatggagggtatgatggtaatttaggagaagagcaaccgttgaaacgtacggcgagtggtggtggtggtgtctcgactggcttgtatatgagtcccggaagtccatcgggatctgacgtcagcgagcaatctagtggtggtgcacacgtgtttaaaccaacggttagatctgaggttacagcgtcatcgtctggtgaagatcctccaacttatcttagtttgtctcttccttggactgacgagacggttcgagtcaacgagccggttcaacttaaccagaatacggttatggacggtggttatacggcggagctgtttccggttagaaaggaagagcaagtggaagtagaagaagaagaagcgaaggggatatctggtggattcggtggtgagttcatgacggtggttcaggagatgataaggacggaggtgaggagttacatggcggatttacagcgaggaaacgtcggtggtagtagttctggcggcggaggtggcggttcgtgtatgccacaaagtgtaaacagccgtcgtgttgggtttagagagtttatagtgaaccaaatcggaattgggaagatggagtaggcggcc

SEQ ID NO: 912 - protein, 320 aa, Arabidopsis thaliana
  G227 polypeptide
MSNPTRKNMERIKGPWSPEEDDLLQRLVQKHGPRNWSLISKSIPGRSGKSCRLRWCNQLSPEVEHRAFSQEEDETIIRAHARFGNKWATISRLLNGRTDNAIKNHWNSTLKRKCSVEGQSCDFGGNGGYDGNLGEEQPLKRTASGGGGVSTGLYMSPGSPSGSDVSEQSSGGAHVFKPTVRSEVTASSSGEDPPTYLSLSLPWTDETVRVNEPVQLNQNTVMDGGYTAELFPVRKEEQVEVEEEEAKGISGGFGGEFMTVVQEMIRTEVRSYMADLQRGNVGGSSSGGGGGGSCMPQSVNSRRVGFREFIVNQIGIGKME

SEQ ID NO: 913 - DNA, 1195 bp, Arabidopsis thaliana
  G242
ctctcaaaaccaaaatcactaaagaggagaagattgctaaagtttgataaaacattccaaaatcaatggctgataggatcaaaggtccatggagtcctgaagaagacgagcagcttcgtaggcttgttgttaaatacggtccaagaaactggacagtgattagcaaatctattcccggtagatcggggaaatcgtgtcgtttacggtggtgcaaccagctttcgccgcaagttgagcatcggccgttttcggctgaggaagacgagacgatcgcacgtgctcacgctcagttcgggaataaatgggcgacgattgctcgtcttctcaacggtcgtacggacaacgccgtgaagaatcactggaactcgacgctcaagaggaaatgcggcggttacgaccatcggggttacgatggttcggaggatcatcggccggttaagagatcggtgagtgcgggatctccacctgttgttactgggctttacatgagcccaggaagcccaactggatctgatgtcagtgattcaagtactatcccgatattaccttccgttgagcttttcaagcctgtgcctagacctggtgctgttgtgctaccgcttcctatcgaaacgtcgtctttttccgatgatccaccgacttcgttaagcttgtcacttcctggtgccgacgtaagcgaggagtcaaaccgtagccacgagtcaacgaatatcaacaacaccacttcgagccgccacaaccacaacaatacggtgtcgtttatgccgtttagtggtgggtttagaggtgcgattgaggaaatggggaagtcttttcccggtaacggaggcgagtttatggcggtggtgcaagagatgattaaggcggaagtgaggagttacatgacggagatgcaacggaacaatggtggcggattcgtcggaggattcattgataatggcatgattccgatgagtcaaattggagttgggagaatcgagtagacaaagtgagattattaggaaactgtttaaattggagaagaagaaaaatgctctgtttttttctcctttggattaggcttaagaattttgggttttaaggaaatgtatagaggaaatcgagtgaacaaagctcgagagctggggacgtagtgacgaagacgaagatcaaatttctcttaagctattcaggaaaataaaataaatttttattt

SEQ ID NO: 914 - protein, 305 aa, Arabidopsis thaliana
  G242 polypeptide
MADRIKGPWSPEEDEQLRRLVVKYGPRNWTVISKSIPGRSGKSCRLRWCNQLSPQVEHRPFSAEEDETIARAHAQFGNKWATIARLLNGRTDNAVKNHWNSTLKRKCGGYDHRGYDGSEDHRPVKRSVSAGSPPVVTGLYMSPGSPTGSDVSDSSTIPILPSVELFKPVPRPGAVVLPLPIETSSFSDDPPTSLSLSLPGADVSEESNRSHESTNINNTTSSRHNHNNTVSFMPFSGGFRGAIEEMGKSFPGNGGEFMAVVQEMIKAEVRSYMTEMQRNNGGGFVGGFIDNGMIPMSQIGVGRIE

SEQ ID NO: 915 - DNA, 891 bp, Arabidopsis thaliana
  G255
agcatcatcatcatcagaagaagagagtcatgggaagatctccttgctgcgagaaagaacacatgaacaaaggtgcttggactaaagaagaagatgagagactagtctcttacatcaagtctcacggtgaaggttgttggcgatctcttcctagagccgctggtctccttcgctgcggtaaaagctgccgtcttcggtggattaactatctccgacctgatctcaaaagaggaaactttacacatgatgaagatgaacttatcatcaagcttcatagcctcctaggcaacaagtggtctttgattgcggcgagattacctggaagaacagataacgagatcaagaactactggaacacacatataaagaggaagcttttgagcaaagggattgatccagccactcatagagggatcaacgaggcaaaaatttctgatttgaagaaaacaaaggaccaaattgtaaaagatgtttcttttgtgacaaagtttgaggaaacagacaagtctggggaccagaagcaaaataagtatattcgaaatgggttagtttgcaaagaagagagagttgttgttgaagaaaaaataggcccagatttgaatcttgagcttaggatcagtccaccatggcaaaaccagagagaaatatctacttgcactgcgtcccgtttttacatggaaaacgacatggagtgtagtagtgaaactgtgaaatgtcaaacagagaatagtagcagcattagctattcttctattgatattagtagtagtaacgttggttatgacttcttgggtttgaagacaagaattttggattttcgaagcttggaaatgaaataaatgaatagtattagattcttaatttgtaggtctgataatgaatgttagattc

SEQ ID NO: 916 - protein, 269 aa, Arabidopsis thaliana
  G255 polypeptide
MGRSPCCEKEHMNKGAWTKEEDERLVSYIKSHGEGCWRSLPRAAGLLRCGKSCRLRWINYLRPDLKRGNFTHDEDELIIKLHSLLGNKWSLIAARLPGRTDNEIKNYWNTHIKRKLLSKGIDPATHRGINEAKISDLKKTKDQIVKDVSFVTKFEETDKSGDQKQNKYIRNGLVCKEERVVVEEKIGPDLNLELRISPPWQNQREISTCTASRFYMENDMECSSETVKCQTENSSSISYSSIDISSSNVGYDFLGLKTRILDFRSLEMK

SEQ ID NO: 917 - DNA, 1470 bp, Arabidopsis thaliana
  G265
ctttggtcttggaagccaaatcaaacctttccttcaatcctcaaattttcgaaaattttctcttttgctttacgttctctcaattcttatttgtaagaaagtttgttcctttaatcaatcaaatcaaagagacttttgaagattgtttcccaatttgcgtcaatcgggatcgagtcaaatctgaaatcttctccactcatcatctgactataagacttaatcaagggactttttgttcgggtttggttttaaacgtcttggattcgaagtggttaaggtatggatgaaaataatggaggttcaagctcacttccacctttccttactaaaacatatgaaatggttgatgattcttcttctgactcggtcgttgcttggagcgaaaacaacaaaagcttcatcgtcaagaatccagcagagttttcaagagaccttcttccgagattcttcaagcataagaatttctcaagtttcatccgtcagcttaatacatatggttttcgaaaagtagatcctgagaaatgggaattcttgaatgatgattttgttagaggtcgaccttaccttatgaagaacattcatagacgaaaaccggttcatagccactcgttagtgaatctacaagcgcaaaatcctttgacggaatcagaaagacggagcatggaggatcagatagaaagactgaaaaatgagaaagaaggccttcttgcggagttacagaaccaagagcaagaacggaaagagtttgagctgcaagtaacgacattgaaagatcggttacaacatatggaacaacatcagaaatcaatagtggcatatgtttcacaggttttgggaaaaccaggactttcactaaacctcgaaaaccatgagagaagaaaaagaagatttcaagagaactctcttcctccaagcagttcacacatagaacaggtcgaaaagttagaatcttcgctaacgttttgggagaatcttgtatcggaatcatgcgagaagagcggtttgcagtcatcaagcatggatcatgatgcagctgagtcaagtctaagtattggcgatacacgacccaaatcatcgaagattgatatgaactcagagccgcccgttaccgttactgcgcctgctccaaaaacaggcgttaacgatgacttttgggaacaatgtttgacagagaaccctggatcaaccgagcaacaagaagttcagtcagagagaagagatgtcggtaatgataataatggtaataagattggaaatcaaaggacgtattggtggaattcagggaatgtaaataacattacagagaaagcttcttgacatgaatgaggtttttgtaaaatagttttcttttggttccactgagattattgtatgtgttcattatttattactctgtttctgtaaaaacaaatctctctattgtttgaggcaggagtgacataaatgcatatgcagaattggtttcaaaaa

SEQ ID NO: 918 - protein, 345 aa, Arabidopsis thaliana
  G265 polypeptide
MDENNGGSSSLPPFLTKTYEMVDDSSSDSVVAWSENNKSFIVKNPAEFSRDLLPRFFKHKNFSSFIRQLNTYGFRKVDPEKWEFLNDDFVRGRPYLMKNIHRRKPVHSHSLVNLQAQNPLTESERRSMEDQIERLKNEKEGLLAELQNQEQERKEFELQVTTLKDRLQHMEQHQKSIVAYVSQVLGKPGLSLNLENHERRKRRFQENSLPPSSSHIEQVEKLESSLTFWENLVSESCEKSGLQSSSMDHDAAESSLSIGDTRPKSSKIDMNSEPPVTVTAPAPKTGVNDDFWEQCLTENPGSTEQQEVQSERRDVGNDNNGNKIGNQRTYWWNSGNVNNITEKAS

SEQ ID NO: 919 - DNA, 922 bp, Arabidopsis thaliana
  G361
tctgtctctctctctctctttgtaaatatacatatatagataagctcacatatatggcgactgaaacatcttctttgaagctcttcggtataaacctacttgaaacgacgtcggttcaaaaccagtcatcggaaccaagacccggatccggatcaggatccgagtcacgtaagtacgagtgtcaatactgttgtagagagtttgctaactctcaagctcttggtggtcaccaaaacgctcacaagaaagagcgtcagcttcttaaacgtgcacagatgttagctactcgtggtttgccacgtcatcataattttcaccctcataccaatccgcttctctccgccttcgcgccgctgcctcacctcctctctcagccgcatcctccgccgcatatgatgctctctccttcttcttcgagttctaagtggctttacggtgaacacatgtcgtcacaaaacgccgttgggtactttcatggtggaaggggactttacggaggtggcatggagtctatggccggagaagtaaagactcatggtggttctttgccggagatgaggaggttcgccggagatagtgatcggagtagcggaattaagttagagaatggtattgggctggacctccatttaagccttgggccatgaatgattataattttggcccagtaaagatctgtaaaatactactaggatttcatttttatagagtatgtttttttccttaatttcggttgaaattggtgaatatttttatctcttacttaccaaatctcatatttctatgtatgcgtttgctttcactttttttttttatataattcttcttgtaaaaaatgcaatgtgagttttcttccctatcattctgtcaagctttggttcaattatttagtaatcgaataatataggaatagtgttgaaag

SEQ ID NO: 920 - protein, 197 aa, Arabidopsis thaliana
  G361 polypeptide
MATETSSLKLFGINLLETTSVQNQSSEPRPGSGSGSESRKYECQYCCREFANSQALGGHQNAHKKERQLLKRAQMLATRGLPRHHNFHPHTNPLLSAFAPLPHLLSQPHPPPHMMLSPSSSSSKWLYGEHMSSQNAVGYFHGGRGLYGGGMESMAGEVKTHGGSLPEMRRFAGDSDRSSGIKLENGIGLDLHLSLGP

SEQ ID NO: 921 - DNA, 977 bp, Arabidopsis thaliana
  G362
ataaaaaacccttcatacaatataaaatttctttagacatacaatatattatactattacagatgcaatgcatcattagttacaaactattaaactaaatatcccccgtctctctcttgctatataaagaagatcatttacacatctccttaagcaaattaaacccatcgataaacacatacgttcacacatatatgtctataaatccgacaatgtctcgtactggcgaaagttcttcaggttcgtcctccgacaagacgataaagctattcggcttcgaactcatcagcggcagtcgtacgccggaaatcacgacggcggaaagcgtgagctcgtccacaaacacgacgtcgttaacagtgatgaaaagacacgagtgccaatactgcggtaaagagtttgcaaattctcaagccttaggaggtcaccaaaacgctcacaagaaggagaggttgaagaagaagaggcttcagcttcaagctcggcgagccagcatcggctattatctcaccaaccaccaacaacccataacgacgtcatttcagagacaatacaaaacgccgtcgtattgtgcattctcctccatgcacgtgaataatgatcagatgggtgtgtacaacgaagattggtcgtcgaggtcgtcgcagattaacttcggtaataatgacacgtgccaagatcttaatgaacaaagcggtgagatgggtaagctgtacggtgttcgaccgaacatgattcagttccagagagatctgagttctcgttctgatcagatgagaagtattaactcgctggatcttcatctaggttttgccggagatgcggcataacaaattaaagagagatatatgattaagattatatgtactatagtggcgtatttcattgggatcatgaaggggaaaaaacgagacatatagtattcttgatgcaatttgagttttgtaatttatttaggtttatgtatgttttcgaag

SEQ ID NO: 922 - protein, 211 aa, Arabidopsis thaliana
  G362 polypeptide
MSINPTMSRTGESSSGSSSDKTIKLFGFELISGSRTPEITTAESVSSSTNTTSLTVMKRHECQYCGKEFANSQALGGHQNAHKKERLKKKRLQLQARRASIGYYLTNHQQPITTSFQRQYKTPSYCAFSSMHVNNDQMGVYNEDWSSRSSQINFGNNDTCQDLNEQSGEMGKLYGVRPNMIQFQRDLSSRSDQMRSINSLDLHLGFAGDAA

SEQ ID NO: 923 - DNA, 774 bp, Arabidopsis thaliana
  G370
atggacgaaaccaacggacgaagagaaactcacgatttcatgaacgtcaacgttgaatccttctctcagcttcctttcatccgccgtactcctcccaaagaaaaagccgccattattcgtctcttcggccaagagctcgtcggtgataactccgacaacttatccgcagaaccttctgatcatcaaaccactaccaagaacgatgagagctctgagaatatcaaggacaaagacaaagaaaaagataaggacaaagacaaagataacaacaacaacaggagattcgagtgtcactactgcttcagaaacttcccaacttctcaagccctaggtggacatcaaaacgctcacaaacgtgaacgtcaacacgccaaacgcggttccatgacatcataccttcatcatcatcagcctcatgaccctcaccacatctacggcttcctcaacaaccaccaccaccgtcactatccgtcttggacgacggaagctagatcatactacggcggagggggacatcaaacgccgtcgtactactcaaggaatactcttgctcctccttcttctaacccaccgacaatcaacggaagtcctttaggtttgtggcgtgtaccgccttccacgtcaacaaatactattcaaggcgtttactcatcttcaccagcttcagcgtttaggtcgcatgagcaagagactaataaggagcctaataactggccgtacagattgatgaaacccaatgtgcaagatcatgtgagtctcgatcttcatctctga

SEQ ID NO: 924 - protein, 257 aa, Arabidopsis thaliana
  G370 polypeptide
MDETNGRRETHDFMNVNVESFSQLPFIRRTPPKEKAAIIRLFGQELVGDNSDNLSAEPSDHQTTTKNDESSENIKDKDKEKDKDKDKDNNNNRRFECHYCFRNFPTSQALGGHQNAHKRERQHAKRGSMTSYLHHHQPHDPHHIYGFLNNHHHRHYPSWTTEARSYYGGGGHQTPSYYSRNTLAPPSSNPPTINGSPLGLWRVPPSTSTNTIQGVYSSSPASAFRSHEQETNKEPNNWPYRLMKPNVQDHVSLDLHL

SEQ ID NO: 925 - DNA, 1125 bp, Arabidopsis thaliana
  G504
cgtcgacctcttgacgatcatgagactgatttcgtgaaaatatcgtcattatatcaaattagaagttgatggaaaacatgggggattcgagcatagggccgggccatccgcatctccctcccgggtttcggtttcacccgactgatgaggaactagtagttcattacctcaagaagaaagcagattctgttccacttccagtctcaatcatcgcagagattgatctttacaagtttgatccttgggagcttccaagcaaggcgagttttggagagcacgagtggtacttctttagtcctcgggatcggaagtatccaaatggggttaggccaaaccgggcagcaacttccggttattggaaagcaacgggaaccgataaaccgatatttacgtgcaatagtcacaaggttggtgtcaagaaagcgcttgttttttacggtggaaagcctcctaaagggataaaaacagattggatcatgcatgaatatcgcctcactgatggtaaccttagcactgcggctaagccgcctgacttaaccacgacaaggaaaaactcactacggctagacgattgggttctatgtaggatctataagaagaatagttcacaaagaccaacaatggagagagtattacttagagaggatctaatggaaggcatgctctcaaaatcatctgctaattcttcttctacatcagtactagacaacaacgacaacaataataacaataacgaagaacactttttcgacggtatggtcgtttcttcagacaaacgttccttgtgtggtcaataccgaatgggccacgaggcctcaggatcatcttcattcggatctttcttatcgagcaagaggtttcatcatacaggtgatctcaacaatgataactacaatgtctcttttgtttcgatgcttagtgagattcctcagagttcggggtttcatgcaaatggtgttatggatacgacgtcgtctctagctgatcatggggttttaagacaggcgtttcagcttcctaacatgaactggcactcataatctatatagatatatatgtgtgtatcatatatgtatctatgcaggcctaatatagtttacacataaatcatctggggcggccgct

SEQ ID NO: 926 - protein, 323 aa, Arabidopsis thaliana
  G504 polypeptide
MENMGDSSIGPGHPHLPPGFRFHPTDEELVVHYLKKKADSVPLPVSIIAEIDLYKFDPWELPSKASFGEHEWYFFSPRDRKYPNGVRPNRAATSGYWKATGTDKPIFTCNSHKVGVKKALVFYGGKPPKGIKTDWIMHEYRLTDGNLSTAAKPPDLTTTRKNSLRLDDWVLCRIYKKNSSQRPTMERVLLREDLMEGMLSKSSANSSSTSVLDNNDNNNNNNEEHFFDGMVVSSDKRSLCGQYRMGHEASGSSSFGSFLSSKRFHHTGDLNNDNYNVSFVSMLSEIPQSSGFHANGVMDTTSSLADHGVLRQAFQLPNMNWHS

SEQ ID NO: 927 - DNA, 1832 bp, Arabidopsis thaliana
  G554
ccttccaaacactattggggaaatggcttcttctcttttttccggtgtaggtttaaggttttagatttgaaggcggatggtgaggagtttgtgttgatgaaatgggtgatttgaagttaaatacctttaagttcttttagccttaagttcttttagcctgtcattacaatatatgtttcagttgtgatcttttggtgctctccaaggtcttagggaatctccgtgtcccctctggtttctttctttgtataaagtctctggaatttaaagatgattttgtcctgttttcttcgaagaatttggcgaagaaacatcaaaagttcactatttgctttacgtgttatgcttgtttgactttgtgtgatctaacttttggttgaaaactaatgctcatcttttgttctttggaatgtcttgatctgcttgattttgaatgctttgtcacattgtttaaacaatttgttctttgttttcagttgaggaaaacatgaattcgacatcgacacattttgtgccaccgagaagagttggtatatacgaacctgtccatcaattcggtatgtggggggagagtttcaaaagcaatattagcaatgggactatgaacacaccaaaccacataataataccgaataatcagaaactagacaacaacgtgtcagaggatacttcccatggaacagcaggaactcctcacatgttcgatcaagaagcttcaacgtctagacatcccgataagatacaaagacggcttgctcaaaaccgcgaggctgctaggaaaagtcgcttgcgcaagaaggcttatgttcagcaactggaaacaagcaggttgaagctaattcaattagagcaagaactcgatcgtgctagacaacagggattctatgtaggaaacggaatagatactaattctctcggtttttcggaaaccatgaatccagggattgctgcatttgaaatggaatatggacattgggttgaagaacagaacagacagatatgtgaactaagaacagttttacacggacacattaacgatatcgagcttcgttcgctagtcgaaaacgccatgaaacattactttgagcttttccggatgaaatcgtctgctgccaaagccgatgtcttcttcgtcatgtcagggatgtggagaacttcagcagaacgattcttcttatggattggcggatttcgaccctccgatcttctcaaggttcttttgccacattttgatgtcttgacggatcaacaacttctagatgtatgcaatctaaaacaatcgtgtcagcaagcagaagacgcgttgactcaaggtatggagaagctgcaacacaccttgcggaccgttgcagcgggacaactcggtgaaggaagttacattcctcaggtgaattctgctatggatagattagaagctttggtcagtttcgtaaatcaggctgatcacttgagacatgaaacattgcaacaaatgtatcggatattgacaacgcgacaagcggctcgaggattattagctcttggtgagtattttcaacggcttagagccttgagctcaagttgggcaactcgacatcgtgaaccaacgtaggtttgagttattttgtaacaaccaaatgaagaaaatggaaagacctcaaaaatgaagaatgagtgcatctgaaaacagaggactactctgaataaatagaggggttgctgctgatatttatttttactctgcggcggaattagaaaatttgaaaaacatcatgtattgataagttgtaaatatcagaaaaaggtgggggtgcaaaaatttgtactttttagcttttgaaagaggcaagttt

SEQ ID NO: 928 - protein, 367 aa, Arabidopsis thaliana
  G554 polypeptide
MNSTSTHFVPPRRVGIYEPVHQFGMWGESFKSNISNGTMNTPNHIIIPNNQKLDNNVSEDTSHGTAGTPHMFDQEASTSRHPDKIQRRLAQNREAARKSRLRKKAYVQQLETSRLKLIQLEQELDRARQQGFYVGNGIDTNSLGFSETMNPGIAAFEMEYGHWVEEQNRQICELRTVLHGHINDIELRSLVENAMKHYFELFRMKSSAAKADVFFVMSGMWRTSAERFFLWIGGFRPSDLLKVLLPHFDVLTDQQLLDVCNLKQSCQQAEDALTQGMEKLQHTLRTVAAGQLGEGSYIPQVNSAMDRLEALVSFVNQADHLRHETLQQMYRILTTRQAARGLLALGEYFQRLRALSSSWATRHREPT

SEQ ID NO: 929 - DNA, 1360 bp, Arabidopsis thaliana
  G555
caaaagtagtaacctttgttggtgattgatactatatctgttgtgggttttagacaaagaccacgtctttgcagttgtagattggaattttccggatctttctctaaatcgctttttctccgagcaacttttgtttggggttaagctcaaagaatccgttcttttcagtctttactccatctagggtaccacgattggatcggtttttatctgatgatttagtaacagagattttgaagaaaaagaaaaatgggagatactagtccaagaacatcagtctcaacagatggagacactgatcataataacctaatgttcgatgaagggcatttgggtatcggtgcttctgattctagtgaccgttcaaagagtaaaatggatcaaaagacgcttcgtaggctcgctcaaaaccgtgaggctgcaaggaaaagcagattgaggaagaaagcatatgttcagcagctagagaacagtcgattgaagctaacacaacttgagcaggagctacaaagagcacggcaacagggtgtctttatctcaagctctggagaccaagcccattctaccgctggagatggggcaatggcatttgatgtagaatacagacgatggcaggaagataaaaacagacagatgaaggagctgagttctgctatagattctcacgcgactgattctgagcttcggataattgtagatggagtaatagctcactatgaggagctttacaggataaaaggcaacgcagctaagagtgatgtcttccatttattatcagggatgtggaaaaccccagctgagagatgtttcttgtggctcggcggtttccgttcatcagaacttctcaagcttatagcgtgtcagttggagcccttgacagaacaacaatcgctagacataaataacttgcaacagtcaactcagcaagcagaagatgctttgtctcaagggatggacaacttacagcaatcactcgctgatactttatcgagtgggactctcggttcaagttcatcagggaatgtagctagctacatgggtcagatggccatggcgatggggaagttaggtacccttgaaggatttatccgccaggctgataacttaaggctacaaacatatcaacagatggtgagactattaacaacccgacaatcggctcgtgctctccttgcagtacacaattatacattgcggttacgtgctcttagctctctatggcttgccagaccaagagagtgaaccatgactctattatacttcaacgaaggtccagaaaatttgagattcttagcataagatttgacgactttagacacgtagctcgtatacaagattatgattatactgttttgtgttg

SEQ ID NO: 930 - protein, 330 aa, Arabidopsis thaliana
  G555 polypeptide
MGDTSPRTSVSTDGDTDHNNLMFDEGHLGIGASDSSDRSKSKMDQKTLRRLAQNREAARKSRLRKKAYVQQLENSRLKLTQLEQELQRARQQGVFISSSGDQAHSTAGDGAMAFDVEYRRWQEDKNRQMKELSSAIDSHATDSELRIIVDGVIAHYEELYRIKGNAAKSDVFHLLSGMWKTPAERCFLWLGGFRSSELLKLIACQLEPLTEQQSLDINNLQQSTQQAEDALSQGMDNLQQSLADTLSSGTLGSSSSGNVASYMGQMAMAMGKLGTLEGFIRQADNLRLQTYQQMVRLLTTRQSARALLAVHNYTLRLRALSSLWLARPRE

SEQ ID NO: 931 - DNA, 1457 bp, Arabidopsis thaliana
  G556
cttttttgaagcccttttgacacaaaagaccagaacaagttgaagaaatatgaatacaacctcgacacattttgttccaccgagaaggtttgaagtttacgagcctctcaaccaaatcggtatgtgggaagaaagtttcaagaacaatggagacatgtatacgcctggctctatcataatcccgactaacgaaaaaccagacagcttgtcagaggatacttctcatgggacagaaggaactcctcacaagtttgaccaagaggcttccacatctagacatcctgataagatacagagaaggctagcacagaatcgagaggcagctaggaaaagtcgtttgcgcaagaaagcttatgttcagcagctagagactagccggttaaagctaattcatttagagcaagaactcgatcgtgctagacaacagggtttctatgtggggaacggagtagataccaatgctcttagtttctcagataacatgagctcagggattgttgcatttgagatggaatatggacattgggtggaagaacagaacaggcaaatatgtgaactaagaacggttttacatggacaagttagtgatatagagcttcgttctctagtcgagaatgccatgaaacattactttcaactcttccgaatgaagtcagccgctgcaaaaatcgatgttttctatgtcatgtccggaatgtggaaaacttcagcagagcggtttttcttgtggataggcggatttagaccctcagagcttctcaaggttctgttaccgcattttgatcctttgacggatcaacaacttttggatgtatgtaatctgaggcaatcatgtcaacaatcagaagatgcgttatcccaaggtatggagaaactgcaacatacattagcagagagtgtagcagccgggaaacttggtgaaggaagttatattcctcaaatgacttgtgctatggagagattggaggctttggtcagctttgtaaatcaagctgatcatctgagacatgagacattgcaacagatgcatcggatcttaaccacgcgacaagcggctagaggtttgttagcattaggggagtatttccaaaggcttcgagctttgagttcgagttgggcggctaggcaacgtgaaccaacgtaattaaggtgtttagatgtcaagaaaggtttgagaccttaacaatcaagaatggagtttgctggtgagtggatttttgggtcaagaacaagagcaataacacaagctgctgtgtgatgatgaatcttgtcttgcggctaaaggaaatgtttgaggaaagttgtacatatgatcagcaacgtaaagtttatagctttttagaaaccaacttttcgatggttgttcttttttttttgtatgtaatattatagataagcttgtggtatatatgattttaatgtgacattacgaacttgatttataaccatggtaaaat

SEQ ID NO: 932 - protein, 364 aa, Arabidopsis thaliana
  G556 polypeptide
MNTTSTHFVPPRRFEVYEPLNQIGMWEESFKNNGDMYTPGSIIIPTNEKPDSLSEDTSHGTEGTPHKFDQEASTSRHPDKIQRRLAQNREAARKSRLRKKAYVQQLETSRLKLIHLEQELDRARQQGFYVGNGVDTNALSFSDNMSSGIVAFEMEYGHWVEEQNRQICELRTVLHGQVSDIELRSLVENAMKHYFQLFRMKSAAAKIDVFYVMSGMWKTSAERFFLWIGGFRPSELLKVLLPHFDPLTDQQLLDVCNLRQSCQQSEDALSQGMEKLQHTLAESVAAGKLGEGSYIPQMTCAMERLEALVSFVNQADHLRHETLQQMHRILTTRQAARGLLALGEYFQRLRALSSSWAARQREPT

SEQ ID NO: 933 - DNA, 1638 bp, Arabidopsis thaliana
  G558
ggaatttcggatcgtgtctctctctgtttctttgtttcaatccgatttcgaatcaagccctttacttgtgcaccttcaagatttcgttttttccagcgcccagaatgctccgggtgaccaacatttgttcctgattcatttcctattggttcgtattgtctgtgcacacaagagaaatttcaagaagttgttactaaaagagaggccacaagtggatattgtctttgttatcaagtgttagtacagaaaagtggtgagaaagtaatatggctgataccagtccgagaactgatgtctcaacagatgacgacacagatcatcctgatcttgggtcggagggagcactagtgaatactgctgcttctgattcgagtgaccgatcgaagggaaagatggatcaaaagactcttcgtaggcttgctcaaaaccgtgaggcagcaaggaaaagcagattgaggaagaaggcttatgttcagcagctagagaacagccgcttgaaactaacccagcttgagcaggagctgcaaagagcaagacagcagggcgtcttcatttcaggcacaggagaccaggcccattctactggtggaaatggtgctttggcgtttgatgctgaacattcacggtggttggaagaaaagaacaagcaaatgaacgagctgaggtctgctctgaatgcgcatgcaggtgattctgagcttcgaataatagtcgatggtgtgatggctcactatgaggagcttttcaggataaagagcaatgcagctaagaatgatgtctttcacttgctatctggcatgtggaaaacaccagctgagagatgtttcttgtggctcggtggatttcgttcatccgaacttctaaagcttctggcgaatcagttggagccaatgacagagagacagttgatgggcataaataacctgcaacagacatcgcagcaggctgaagatgctttgtctcaagggatggagagcttacaacagtcactagctgatactttatcgagcgggactcttggttcaagttcatcagggaatgtcgcaagctacatgggtcagatggccatggcaatgggaaagttaggtacactcgaaggatttatccgccaggctgataatttgagactacaaacattgcaacagatgataagagtattaacaacgagacagtcagcacgtgctctacttgcaatacacgattacttctcacggctacgagctctaagctccttatggcttgctcgacccagagagtgaaactgtattttggtcacatgtcagctgtacaaaatccatatggacacaaaaccaggagagactattaatcaacacttgtcagattcttcttaccaaatccatcaacaaataagcaaatttctgggaaacaaaagactctttgtatgtaggtttcttctacatggttgtggtaattcatgttgttttagttgtagtcatcagtttttaatttagcatttgaaaagttcaatgttgtttatatagcatcttcgattatcttagaaaggttattgaattttgtttttttttgttacttttgtgtgtggtaaaggtgttttaaccttgcaacttctgtactgtaatcatttaacaatattaagatgttctatttgagttttgt

SEQ ID NO: 934 - protein, 330 aa, Arabidopsis thaliana
  G558 polypeptide
MADTSPRTDVSTDDDTDHPDLGSEGALVNTAASDSSDRSKGKMDQKTLRRLAQNREAARKSRLRKKAYVQQLENSRLKLTQLEQELQRARQQGVFISGTGDQAHSTGGNGALAFDAEHSRWLEEKNKQMNELRSALNAHAGDSELRIIVDGVMAHYEELFRIKSNAAKNDVFHLLSGMWKTPAERCFLWLGGFRSSELLKLLANQLEPMTERQLMGINNLQQTSQQAEDALSQGMESLQQSLADTLSSGTLGSSSSGNVASYMGQMAMAMGKLGTLEGFIRQADNLRLQTLQQMIRVLTTRQSARALLAIHDYFSRLRALSSLWLARPRE

SEQ ID NO: 935 - DNA, 978 bp, Arabidopsis thaliana
  G578
atgcatagtttgaatgaaacagtaattcctgatgttgattacatgcagtctgatagagggcatatgcatgctgctgcctctgattccagtgatcgatcaaaggataagttggatcaaaagacccttcgtaggcttgctcaaaatcgtgaggcagcaagaaaaagcagattgaggaagaaggcgtatgttcagcagctggaagatagtcgattaaagctgactcaagttgagcaggagctgcaaagagcaagacagcagggagttttcatctcaagttcaggagaccaagctcattctactggtggcaatggtggggctttggcatttgatgcagaacactcacgatggcttgaagaaaagaacaggcaaatgaacgagctgagatctgccctgaatgctcatgcaggtgatactgagctccggataattgtggatggagtgatggctcactatgaggagcttttcaggattaagagcaatgcatctaagaatgatgtcttccacttgttatctggaatgtggaaaacaccagctgagcgatgtttcttgtggcttggcgggttcccgtcatccgaacttctcaagcttcttgcgaatcagctagagcccatgacagaacgacaggtaatgggcatcaatagcttgcagcagacgtcgcagcaggcagaagatgctttatctcaagggatggagagtttacagcaatccctagctgatactttatccagtggaactcttggttccagttcatcggataatgtcgcgagctacatgggtcagatggccatggcaatgggcaagttaggcaccctcgaaggattcatacgccaggctgataacttgaggctgcaaacactacaacagatgcttcgagtattaacaacacgtcagtcagctcgtgctcttcttgctatacacgattattcatctcgattacgtgctcttagttccttgtggcttgcccggccaagagagtga

SEQ ID NO: 936 - protein, 325 aa, Arabidopsis thaliana
  G578 polypeptide
MHSLNETVIPDVDYMQSDRGHMHAAASDSSDRSKDKLDQKTLRRLAQNREAARKSRLRKKAYVQQLEDSRLKLTQVEQELQRARQQGVFISSSGDQAHSTGGNGGALAFDAEHSRWLEEKNRQMNELRSALNAHAGDTELRIIVDGVMAHYEELFRIKSNASKNDVFHLLSGMWKTPAERCFLWLGGFPSSELLKLLANQLEPMTERQVMGINSLQQTSQQAEDALSQGMESLQQSLADTLSSGTLGSSSSDNVASYMGQMAMAMGKLGTLEGFIRQADNLRLQTLQQMLRVLTTRQSARALLAIHDYSSRLRALSSLWLARPRE

SEQ ID NO: 937 - DNA, 1557 bp, Arabidopsis thaliana
  G629
cgaaatgaaaaaattctctgtattaccagaaacgtgtttcataagcatctttaactcttcagctctcaaattcttcatgaatatctctgcttatcggatcaagtgagagcaaatgcaatttttaagagccagctattggatctataactgaagaggatatatatagagatgatgagttcttcttctccaacacaacttgcatctttaagagacatgggaatctatgagccatttcaacaaattgtcggttggggaaatgttttcaaatctgatatcaatgatcatagtcccaatactgctacttcctctattattcaggttgatcctagaattgatgatcacaacaacaacatcaagataaattatgattcttctcataaccagatcgaagcagaacaaccttctagtaatgataatcaagatgatgatggcaggattcatgataagatgaaacggcgtttagcgcagaaccgagaagcggctcgcaaaagtcgtttgagaaagaaggcttatgttcagcagttagaggaaagccggttaaagttatcgcagttagagcaagaactcgaaaaggttaagcagcagggccatttaggaccatctgggagtattaacacagggattgcatcatttgagatggaatattcacactggctacaagaacaaagcagaagagttagcgaactacgaacagcgcttcaatctcatataagcgacatagaactcaagatgctagtagagagttgcttgaaccattacgctaatcttttccgaatgaaatccgatgcagcaaaagccgatgttttctacttgatatcgggaatgtggcgaacttcaaccgaaagattcttccaatggattggagggtttcgtccatccgaacttttaaacgttgtgatgccttatcttcaaccattaacggatcaacaaatcttggaagtgagaaacctccaacaatcatcacaacaagcagaggatgctctgtctcaagggattgataaacttcaacagagtttagctgaaagcattgtgattgatgcggttatcgagtccacgcattatcccactcacatggctgcagctatagagaatcttcaagcattagaaggatttgtgaatcaagcagatcatctgaggcaacaaactttgcaacaaatggcgaagatcttaacgacaagacaatcggctcgaggtttactagctttaggagagtatcttcatagacttcgtgctcttagttctctttgggcagctcgtccacaagaaccaacttaaaagaggaacttattaaaactttaaaaacaagaaacagcagaatcaaaagtcttgaagaagcatactcatcacaaagcttggaaggatgttttaaaaaagatctttgttaattaagtagagtgagattctcttgattagaactttatggtttttgctttatgaagtatctctccagagaagattgtaaatttgggttgaaactttgtaatatattaagatccaccaaataagtttgaaatctgagcaatttgataataaaaaaaaaaaaaaaaaaaaaaaaaa

SEQ ID NO: 938 - protein, 368 aa, Arabidopsis thaliana
  G629 polypeptide
MMSSSSPTQLASLRDMGIYEPFQQIVGWGNVFKSDINDHSPNTATSSIIQVDPRIDDHNNNIKINYDSSHNQIEAEQPSSNDNQDDDGRIHDKMKRRLAQNREAARKSRLRKKAYVQQLEESRLKLSQLEQELEKVKQQGHLGPSGSINTGIASFEMEYSHWLQEQSRRVSELRTALQSHISDIELKMLVESCLNHYANLFRMKSDAAKADVFYLISGMWRTSTERFFQWIGGFRPSELLNVVMPYLQPLTDQQILEVRNLQQSSQQAEDALSQGIDKLQQSLAESIVIDAVIESTHYPTHMAAAIENLQALEGFVNQADHLRQQTLQQMAKILTTRQSARGLLALGEYLHRLRALSSLWAARPQEPT

SEQ ID NO: 939 - DNA, 1640 bp, Arabidopsis thaliana
  G776
tgcaattgaaggtgaggtttggtgaaagggaaattgagaaaaccctagaacaagtacggtctctattttgctttaatgggtcgcgaatctgtggctgttgtgactgcgccgccctcggcgactgctccgggtactgcttcggtggcgacctcgcttgctcctggcttccgatttcatccgactgatgaggaactcgtgagctattacttgaagaggaaggttctgggccaacctgtacgcttcgatgcgattggagaggtcgatatatacaagcatgagccctgggatttagcagtgttttcgagattgaagacaagggaccaagaatggtacttctacagtgcattagataagaagtatggaaacggtgctaggatgaaccgagcaactaacagagggtactggaaagctactggaaaagacagagaaatccgccgtgacattctgcttctcggtatgaaaaagacacttgttttccacagtgggcgtgcaccagacgggcttcggactaattgggttatgcatgagtatcgccttgtggaatatgaaaccgagaaaaacggaaacctggtgcaagatgcatatgtgttgtgtagagtcttccacaagaataacattgggccaccaagtgggaacagatatgctccgttcatggaagaggaatgggctgatgatgaaggagctctgattccaggaatagacgttaagctcaggctagagccgccgccagtagccaatggaaacgaccagatggaccaggaaatccagtcagccagcaagagtctcatcaacatcaatgagccaccgagagagacagctccactggatatcgaatcggaccaacagaatcatcatgagaatgacctcaagccggaggagcataacaacaataataattatgatgaaaacgaggaaacactcaaacgcgagcagatggaagaagaggagcgtcctcctcgacctgtatgcgttctcaacaaagaagctccattacctcttctgcaatacaaacgtagacgccaaagcgagtccaacaacaactcaagcaggaacacacaggaccattgttcgtccacaacaacaactgtcgacaatacaaccactttaatctcatcatctgccgctgccaccaacactgccatctctgcattgcttgagttctcactcatgggtatctccgacaagaaagaaaagccgcagcaaccgctacgtcctcacaaggaacctttgcctcctcaaactccacttgcatctcctgaagagaaggttaatgatctccagaaggagattcaccagatgtctgttgaaagagaaactttcaagcttgaaatgatgagtgcagaagctatgatcagtattctccagtcaaggatcgatgcgctgcgtcaggagaacgaggaactcaagaagaacaatgctaatggacaataaaggctctaaaaacatctctccaggttacttcttattgcccttcgccttttatttagctttaatctccctaatactatgacccatctacatagctcctctagacagattgcgaactgtgtgaatctctgttgtaacataggataaaacggattcgagcccctgagctgagtgttttatccttcttcttttaaaaaaaaaaaaaaaaaaaa

SEQ ID NO: 940 - protein, 451 aa, Arabidopsis thaliana
  G776 polypeptide
MGRESVAVVTAPPSATAPGTASVATSLAPGFRFHPTDEELVSYYLKRKVLGQPVRFDAIGEVDIYKHEPWDLAVFSRLKTRDQEWYFYSALDKKYGNGARMNRATNRGYWKATGKDREIRRDILLLGMKKTLVFHSGRAPDGLRTNWVMHEYRLVEYETEKNGNLVQDAYVLCRVFHKNNIGPPSGNRYAPFMEEEWADDEGALIPGIDVKLRLEPPPVANGNDQMDQEIQSASKSLININEPPRETAPLDIESDQQNHHENDLKPEEHNNNNNYDENEETLKREQMEEEERPPRPVCVLNKEAPLPLLQYKRRRQSESNNNSSRNTQDHCSSTTTTVDNTTTLISSSAAATNTAISALLEFSLMGISDKKEKPQQPLRPHKEPLPPQTPLASPEEKVNDLQKEIHQMSVERETFKLEMMSAEAMISILQSRIDALRQENEELKKNNANGQ

SEQ ID NO: 941 - DNA, 952 bp, Arabidopsis thaliana
  G812
tcgaaatcatcaagaatcttgtctttaatttccaattgggtttttcaaaacccgttacctcaggatgatgaacccgtttctcccggaaggctgcgatccaccaccaccaccacaaccaatggagggtttacacgaaaatgctccacctccatttctgaccaagacatttgagatggtggatgatccaaacactgaccacatcgtatcttggaacagaggaggaacaagttttgtcgtctgggatttgcattctttctccacgattctccttcctcgtcatttcaaacacagcaatttctcaagtttcatcagacaactcaatacttatggtttcagaaagatagaagcagagagatgggaatttgcaaacgaagagtttttgttaggacaaagacagttgttgaagaacatcaagaggagaaacccttttactccatcatcttcaccaagccatgacgcttgcaacgagcttcgcagagagaagcaagtgctaatgatggagatagtgagtctaagacagcagcaacaaacaacgaaaagctacatcaaagctatggaacagaggatagaaggaacagagaggaaacagagacaaatgatgtcgtttctggctagagcaatgcagagtccttcgtttttgcatcagttgttgaaacaaagagataaaaaaattaaggagcttgaggataatgagtcagcaaagaggaaaagaggttcttcttcgatgtcggaattggaagttttggctttggagatgcaagggcatggaaaacagaggaatatgttggaagaagaggatcatcaactggtggtagagagagagttggatgatggtttctgggaagagttgcttagtgatgagagtttggcttccacctcctaactagatggatttctttttggttttgtttttagtttcttctactttcaagctcattttcttctgtcacaa

SEQ ID NO: 942 - protein, 272 aa, Arabidopsis thaliana
  G812 polypeptide
MMNPFLPEGCDPPPPPQPMEGLHENAPPPFLTKTFEMVDDPNTDHIVSWNRGGTSFVVWDLHSFSTILLPRHFKHSNFSSFIRQLNTYGFRKIEAERWEFANEEFLLGQRQLLKNIKRRNPFTPSSSPSHDACNELRREKQVLMMEIVSLRQQQQTTKSYIKAMEQRIEGTERKQRQMMSFLARAMQSPSFLHQLLKQRDKKIKELEDNESAKRKRGSSSMSELEVLALEMQGHGKQRNMLEEEDHQLVVERELDDGFWEELLSDESLASTS

SEQ ID NO: 943 - DNA, 513 bp, Arabidopsis thaliana
  G997
tcgacccacgcgtccgatacaaaccaaccttctcaattcctctcttttcatccacattttcactagctaatggcttctagttcaatgagcacctcatcatggacagctagagaggacaagcaattcgaaatggcgttggcgaaattcgacaaggacactcctgaccgttggcaaaaaattgcaagggcagttggtgggaaatcaactgaagaagtaaagcgacactatgaattgctccttagggatgtgaatgacattgagtcaggacgctatccacaacctaggtaccgtaacactaattgaagccattaataaaatgcctttctatcaagaagaggacatttgagagaatctataaagaactaagaatttcgatgtatttcttatattctatttgctttctttttttgtttttttttttaatttctgtttggttttcagatatataataatctctctcaatatccatcctattctaatccaatcaatttaagttcatataaaaaaaaaaaa

SEQ ID NO: 944 - protein, 77 aa, Arabidopsis thaliana
  G997 polypeptide
MASSSMSTSSWTAREDKQFEMALAKFDKDTPDRWQKIARAVGGKSTEEVKRHYELLLRDVNDIESGRYPQPRYRNTN

SEQ ID NO: 945 - DNA, 1322 bp, Arabidopsis thaliana
  G1133
ttcaagaaagaatcaccaagtgttgcgttccacacatttgagcaacagcttccacaatcgtattgtattcctgtaaagttcccttggcttaaactgcaagagcatgcctcttgataccaaacagcagaaatggttgccattaggcttaaatcctcaagcttgtgtccaggacaaggcgactgagtatttccgtcctggaattccttttccggaactcggtaaagtttatgcagctgagcatcagtttcgctatttgcagccaccgttccaagccttattgtctagatatgatcagcagtcttgtggaaaacaagtttcatgtttgaatgggcgatctagcaacggtgctgctccagagggggcactcaagtcttctcggaaaagatttatagtattcgatcagtcgggagagcagactcgtttgttacaatgtggatttcctctgcggtttccttcttctatggatgcagagcgagggaacattctcggtgccctacacccagagaaagggtttagtaaagatcatgccattcaagaaaagatattgcaacatgaagatcatgaaaatggcgaagaagactcggaaatgcacgaagacactgaggaaatcaacgcgttactgtattctgatgatgacgataatgatgattgggaaagtgatgatgaagtaatgagcactggtcactctccattcacagttgaacaacaagcgtgcaacataacaacagaagagctggatgaaactgaaagcactgttgatggtccacttcttaaaagacagaaactactggaccattcgtacagagactcatcaccatcccttgtgggcaccactaaagtcaaaggcttatcagatgaaaaccttcctgaatcaaacatttcaagcaaacaagaaacgggttctggtttgagcgacgagcagtcaagaaaagacaagattcacaccgctctgagaatcctggagagtgtagttccaggggcaaagggaaaagaagctcttttactactagacgaagccattgattacctcaagttgctgaagcaaagcttaaactcatcaaagggtttgaataaccattggtgaaaaacctacaaccccttttgtcctattgataaggcatgtttggttggttaaagagaagacatgggacaaaagataatcaatgaggtaaaggactgatgaagaagattctctcaaattcattaacgtgggtttgaaacaattagaacacgcctggtgaccctagtgggaccgtatccactgttcatctagctggatcaatagtggtttacttttggatttggcatgctctctcaaaaaa

SEQ ID NO: 946 - protein, 326 aa, Arabidopsis thaliana
  G1133 polypeptide
MPLDTKQQKWLPLGLNPQACVQDKATEYFRPGIPFPELGKVYAAEHQFRYLQPPFQALLSRYDQQSCGKQVSCLNGRSSNGAAPEGALKSSRKRFIVFDQSGEQTRLLQCGFPLRFPSSMDAERGNILGALHPEKGFSKDHAIQEKILQHEDHENGEEDSEMHEDTEEINALLYSDDDDNDDWESDDEVMSTGHSPFTVEQQACNITTEELDETESTVDGPLLKRQKLLDHSYRDSSPSLVGTTKVKGLSDENLPESNISSKQETGSGLSDEQSRKDKIHTALRILESVVPGAKGKEALLLLDEAIDYLKLLKQSLNSSKGLNNHW

SEQ ID NO: 947 - DNA, 1413 bp, Arabidopsis thaliana
  G1141
gtctttacaaaaagaaaagaaaaaagagacgctagaaagaacgcgaaagcttgcgaagaagatttgcttttgatcgacttaacacgaacaacaaacaacatctgcgtgataaagaagagatttttgcctaaataaagaagagattcgactctaatcctggagttatcattcacgatagattcttagattgcgactataaagaagaagatggctgtatatgaacaaaccggaaccgagcagccgaagaaaaggaaatctagggctcgagcaggtggtttaacggtggctgataggctaaagaagtggaaagagtacaacgagattgttgaagcttcggctgttaaagaaggagagaaaccgaaacgcaaagttcctgcgaaagggtcgaagaaaggttgtatgaagggtaaaggaggaccagataattctcactgtagttttagaggagttagacaaaggatttggggtaaatgggttgcagagattcgagaaccgaaaataggaactagactttggcttggtacttttcctaccgcggaaaaagctgcttccgcttatgatgaagcggctaccgctatgtacggttcattggctcgtcttaacttccctcagtctgttgggtctgagtttactagtacgtctagtcaatctgaggtgtgtacggttgaaaataaggcggttgtttgtggtgatgtttgtgtgaagcatgaagatactgattgtgaatctaatccatttagtcagattttagatgttagagaagagtcttgtggaaccaggccggacagttgcacggttggacatcaagatatgaattcttcgctgaattacgatttgctgttagagtttgagcagcagtattggggccaagttttgcaggagaaagagaaaccgaagcaggaagaagaggagatacagcaacagcaacaggaacagcaacagcaacagctgcaaccggatttgcttactgttgcagattacggttggccttggtctaatgatattgtaaatgatcagacttcttgggatcctaatgagtgctttgatattaatgaactccttggagatttgaatgaacctggtccccatcagagccaagaccaaaaccacgtaaattctggtagttatgatttgcatccgcttcatctcgagccacacgatggtcacgagttcaatggtttgagttctctggatatttgagagttctgaggcaatggtcctacaagactacaacataatctttggattgatcataggagaaacaagaaataggtgttaatgatctgattcacaatgaaaaaatatttaataactctatagtttttgttctttccttggatcatgaactgttgcttctcatctattgagttaatatagcgaatagcagagtttctctcataaaaaaaaaaaaaa

SEQ ID NO: 948 - protein, 330 aa, Arabidopsis thaliana
  G1141 polypeptide
MAVYEQTGTEQPKKRKSRARAGGLTVADRLKKWKEYNEIVEASAVKEGEKPKRKVPAKGSKKGCMKGKGGPDNSHCSFRGVRQRIWGKWVAEIREPKIGTRLWLGTFPTAEKAASAYDEAATAMYGSLARLNFPQSVGSEFTSTSSQSEVCTVENKAVVCGDVCVKHEDTDCESNPFSQILDVREESCGTRPDSCTVGHQDMNSSLNYDLLLEFEQQYWGQVLQEKEKPKQEEEEIQQQQQEQQQQQLQPDLLTVADYGWPWSNDIVNDQTSWDPNECFDINELLGDLNEPGPHQSQDQNHVNSGSYDLHPLHLEPHDGHEFNGLSSLDI

SEQ ID NO: 949 - DNA, 1780 bp, Arabidopsis thaliana
  G1198
tcttttcaaattccaatcatttgatcaactaatcaagaattaattataagactttgcaatctctctccctctccctctccctagctagttctctcttgtgtttcttaactcgagcttctctcaatagtgattatcatctttttcatcatttcaagatttaatgtgttttgcagaaaagagactaatcaagaagagatatcatcaattgaagctgttttcttgagtagagatggcgaaccatagaatgagcgaagctacaaaccataaccacaatcatcatcttccttattcacttattcatggtctcaacaacaatcatccatcttctggtttcattaaccaagatggatcgtccagtttcgattttggagagctagaagaagcaattgttctgcaaggtgtcaagtataggaacgaggaagccaagccacctttattaggaggaggaggaggagctacgactctggagatgttcccttcgtggccaatcagaactcaccaaactcttcctactgagagttccaagtcaggaggagagagcagcgattcaggatcggctaatttctccggcaaagctgaaagtcaacaaccggagtctcctatgagtagcaaacatcatctcatgcttcaacctcatcataataacatggcaaactcaagttcaacatctggacttccttccacttctcgaactttagctcctcctaaaccttcggaagataagaggaaggctacaacttcaggcaaacagcttgatgctaagacgttgagacgtttggcccaaaatagagaagctgctcgcaaaagccgtcttaggaaaaaggcgtatgtgcaacagctagaatcaagtaggataaagctttcccaattggagcaagaacttcagcgagctcgttctcaggggctgttcatgggtggttgtggaccaccaggacctaacatcacttccggagctgcaatatttgacatggaatatgggagatggctagaggatgataaccggcatatgtcggagattcgaaccggtcttcaggctcatttatctgacaatgatttaaggttgatcgttgacggttacattgctcattttgatgagatattccgattaaaagccgtggcagcgaaagccgatgtttttcacctcatcattgggacatggatgtccccagccgaacgttgttttatttggatggctggtttccgtccatccgacctaatcaagatattggtgtcgcaaatggatctattgacggagcaacaactgatgggaatatatagcctacaacactcgtcgcaacaagcagaggaggctctctcgcaaggcctcgaacaacttcagcaatctctcatcgatactctcgccgcatctccagtcattgacggaatgcaacaaatggctgtcgctctcggaaagatctctaatctcgaaggctttatccgccaggctgataacttgaggcagcagaccgttcaccagctgaggcggatcttgaccgtccgacaagctgcacggtgtttcctagtcatcggagagtactatggacggctcagagctcttagctccctttggttgtcacgcccacgagagacactgatgagtgatgaaacctcttgtcaaacgacgacggatttgcagattgttcagtcatctcggaaccacttctccaatttctgaatggaatgaaactttgtataactaaaaggccaagtttcattgtctgtcgtaatttcacctatttcctttaaagttgtactagagaaaagataggatcttccttcg

SEQ ID NO: 950 - protein, 481 aa, Arabidopsis thaliana
  G1198 polypeptide
MANHRMSEATNHNHNHHLPYSLIHGLNNNHPSSGFINQDGSSSFDFGELEEAIVLQGVKYRNEEAKPPLLGGGGGATTLEMFPSWPIRTHQTLPTESSKSGGESSDSGSANFSGKAESQQPESPMSSKHHLMLQPHHNNMANSSSTSGLPSTSRTLAPPKPSEDKRKATTSGKQLDAKTLRRLAQNREAARKSRLRKKAYVQQLESSRIKLSQLEQELQRARSQGLFMGGCGPPGPNITSGAAIFDMEYGRWLEDDNRHMSEIRTGLQAHLSDNDLRLIVDGYIAHFDEIFRLKAVAAKADVFHLIIGTWMSPAERCFIWMAGFRPSDLIKILVSQMDLLTEQQLMGIYSLQHSSQQAEEALSQGLEQLQQSLIDTLAASPVIDGMQQMAVALGKISNLEGFIRQADNLRQQTVHQLRRILTVRQAARCFLVIGEYYGRLRALSSLWLSRPRETLMSDETSCQTTTDLQIVQSSRNHFSNF

SEQ ID NO: 951 - DNA, 965 bp, Arabidopsis thaliana
  G1335
tttttttttaaaagatttagagagaaaagtgagttattaagagattccaatcaaaatgagcggagacaacggcggtggtgagaggcgcaaaggctccgtcaagtggtttgatacccagaagggtttcggcttcatcactcctgacgacggtggcgacgatctcttcgttcaccagtcctccatcagatctgagggtttccgtagcctcgctgccgaagaagccgtagagttcgaggttgagatcgacaacaacaaccgtcccaaggccatcgatgtttctggacccgacggcgctcccgtccaaggaaacagcggtggtggttcatctggcggacgcggcggtttcggtggaggaagaggaggtggacgcggatctggaggtggatacggcggtggcggtggtggatacggaggaagaggaggtggtggtcgaggaggcagcgactgctacaagtgtggtgagcccggtcacatggcgagagactgttctgaaggcggtggaggttacggaggaggcggcggtggctacggaggtggaggcggatacggcggaggaggtggtggttacggaggtggtggccgtggaggtggtggcggcgggggaagctgctacagctgtggcgagtcgggacatttcgccagggattgcaccagcggtggacgttaaaaccaacgccggttacgcggtggagaagagtgagttggttatctcacaagtgatcggttctttctcccgccgccttctatctctctattatccactttttgcttattatgatggatctctatctttgttagttggttttttcttgatggtttcggattaggactcttcttttggttttgctacttatggttggttttatttatggtacttgtgatatgggtgaaatgctctacttgttgctctgtttcaagtgttcataatatgcgaacaaatattctgggttttgtttcaaaaaaaa

SEQ ID NO: 952 - protein, 203 aa, Arabidopsis thaliana
  G1335 polypeptide
MSGDNGGGERRKGSVKWFDTQKGFGFITPDDGGDDLFVHQSSIRSEGFRSLAAEEAVEFEVEIDNNNRPKAIDVSGPDGAPVQGNSGGGSSGGRGGFGGGRGGGRGSGGGYGGGGGGYGGRGGGGRGGSDCYKCGEPGHMARDCSEGGGGYGGGGGGYGGGGGYGGGGGGYGGGGRGGGGGGGSCYSCGESGHFARDCTSGGR

SEQ ID NO: 953 - DNA, 1319 bp, Arabidopsis thaliana
  G1454
ctagtagtgatgatatgatcgcttcttctcctacaatctcagaaacctccgatcacggttttagatatcttctacaacggatacaatggagagcaccgattcttccggtggtccaccaccgccacaacctaaccttcctccaggcttccggtttcaccctaccgacgaagagcttgttgttcactacctcaaacgcaaagcagcctctgctcctttacctgtcgccatcatcgccgaagtcgatctctataaatttgatccatgggaacttcccgctaaagcatcgtttggagaacaagaatggtacttctttagtccacgagatcggaagtatccaaacggagcaagaccaaacagagcggcgacttcaggttattggaaagcgaccggtacagataaaccggtacttgcttccgacggtaaccaaaaggtgggcgtgaagaaggcactagtcttctacagtggtaaaccaccaaaaggcgttaaaagtgattggatcatgcatgagtatcgtctcatcgaaaacaaaccaaacaatcgacctcctggctgtgatttcggcaacaaaaaaaactcactcagacttgatgattgggtgttatgtagaatctacaagaagaacaacgcaagtcgacatgttgataacgataaggatcatgatatgatcgattacattttcaggaagattcctccgtctttatcaatggcggctgcttctacaggacttcaccaacatcatcataatgtctcaagatcaatgaatttcttccctggcaaattctccggtggtggttacgggattttctctgacggtggtaacacgagtatatacgacggcggtggcatgatcaacaatattggtactgactcagtagatcacgacaataacgctgacgtcgttggtttaaatcatgcttcgtcgtcaggtcctatgatgatggcgaatttgaaacgaactctcccggtgccgtattggcctgtagcagatgaggagcaagatgcatctccgagcaaacggtttcacggtgtaggaggaggaggaggagattgttcgaacatgtcttcctccatgatggaagagactccaccattgatgcaacaacaaggtggtgtgttaggagatggattattcagaacgacatcgtaccaattacccggtttaaattggtactcttcttaatcaaatgtgtttcgccgccggtgtgaagaattttccggtgacagtgaagatttttttccgattggtggggtcatttgcatgcattatataatttgagatttgtgtatatgttttgggttaattaattggtcacaggggc

SEQ ID NO: 954 - protein, 364 aa, Arabidopsis thaliana
  G1454 polypeptide
MESTDSSGGPPPPQPNLPPGFRFHPTDEELVVHYLKRKAASAPLPVAIIAEVDLYKFDPWELPAKASFGEQEWYFFSPRDRKYPNGARPNRAATSGYWKATGTDKPVLASDGNQKVGVKKALVFYSGKPPKGVKSDWIMHEYRLIENKPNNRPPGCDFGNKKNSLRLDDWVLCRIYKKNNASRHVDNDKDHDMIDYIFRKIPPSLSMAAASTGLHQHHHNVSRSMNFFPGKFSGGGYGIFSDGGNTSIYDGGGMINNIGTDSVDHDNNADVVGLNHASSSGPMMMANLKRTLPVPYWPVADEEQDASPSKRFHGVGGGGGDCSNMSSSMMEETPPLMQQQGGVLGDGLFRTTSYQLPGLNWYSS

SEQ ID NO: 955 - DNA, 1564 bp, Arabidopsis thaliana
  G1664
ctctctctctctctctactagtttgacatgaacagcgacggtgtttggcttgacggctccggtgaatctccggaagttaataacggtgaagctgcgtcttgggtcagaaacccagatgaagactggttcaataacccaccaccaccacaacacactaatcaaaacgacttcagattcaatggtggctttcctttaaacccctcagagaatctgcttcttcttcttcagcaatcgattgattcttcttcttcttcttctccgttattacatcctttcacactcgacgctgcttcacagcaacaacaacaacaacaacaacaacaggaacagtctttcttagctacgaaagcttgtatagtttctcttctcaacgtcccaaccatcaataacaacactttcgatgacttcggctttgactctggtttcttaggacaacaattccatggaaatcatcaatctccgaactcgatgaatttcactggcttaaaccactcagtaccggattttcttccagctccggaaaacagctcaggatcatgtggattgagtcctctgttctcaaacagagcaaaggttttaaaaccgttacaggtaatggcttcatctggctcgcagccaactctgtttcagaaacgagctgcaatgcgtcagagctcgagtagcaaaatgtgcaattctgagagttcttctgaaatgaggaaatcgagctacgagagagagattgacgatactagtaccggaatcatcgatatctctggattgaattacgaatctgatgaccataatactaataacaacaaaggtaagaagaaaggaatgcctgcaaagaatcttatggctgagagaagaagaaggaagaagcttaatgataggctttacatgcttagatcagttgttcccaagatcagcaaaatggatagagcatcaatacttggagatgctattgattacctcaaagagcttttacaaagaatcaacgatcttcacaccgaacttgaatctactccaccgagttcttcaagcttgcatccgttaacaccgactccacaaacgctgtcttaccgtgttaaggaagagttgtgtccatcttcctccttgccaagtcctaaaggccaacaaccaagagttgaggttagattaagagaaggaaaggcagtgaacatacacatgttctgtggacgtagaccaggtcttttactttccaccatgagagctttggataacttaggattggatgttcaacaagcggtgattagctgtttcaatggttttgctttggatgttttccgcgctgagcaatgtcaagaagaccatgacgtgttacctgaacaaatcaaagcagtgcttttagatacagcaggttacgctggtttggtttgattgcgaagcagaaggaagcatctgtgtggaacagagctagatctaagtccttgttctgttttagtcagcaattttcttacttagtttcatcaatttcaatcatgtatggaagatgataactgttttattttagctatgagaacatgtgtttggggaacaatagttgcaacctttgagcaaaaaa

SEQ ID NO: 956 - protein, 450 aa, Arabidopsis thaliana
  G1664 polypeptide
MNSDGVWLDGSGESPEVNNGEAASWVRNPDEDWFNNPPPPQHTNQNDFRFNGGFPLNPSENLLLLLQQSIDSSSSSSPLLHPFTLDAASQQQQQQQQQQEQSFLATKACIVSLLNVPTINNNTFDDFGFDSGFLGQQFHGNHQSPNSMNFTGLNHSVPDFLPAPENSSGSCGLSPLFSNRAKVLKPLQVMASSGSQPTLFQKRAAMRQSSSSKMCNSESSSEMRKSSYEREIDDTSTGIIDISGLNYESDDHNTNNNKGKKKGMPAKNLMAERRRRKKLNDRLYMLRSVVPKISKMDRASILGDAIDYLKELLQRINDLHTELESTPPSSSSLHPLTPTPQTLSYRVKEELCPSSSLPSPKGQQPRVEVRLREGKAVNIHMFCGRRPGLLLSTMRALDNLGLDVQQAVISCFNGFALDVFRAEQCQEDHDVLPEQIKAVLLDTAGYAGLV

SEQ ID NO: 957 - DNA, 678 bp, Arabidopsis thaliana
  G1897
atgccttctgaattcagtgaatctcgtcgggttcctaagattccccacggccaaggaggatctgttgcgattccgacggatcaacaagagcagctttcttgtcctcgctgtgaatcaaccaacaccaagttctgttactacaacaactacaacttctcacaacctcgtcatttctgcaagtcttgtcgccgttactggactcatggaggtactctccgtgacattcccgtcggtggtgtttcccgtaaaagctcaaaacgttcccggacttattcctctgccgctaccacctccgttgtcggaagccggaactttcccttacaagctacgcctgttcttttccctcagtcgtcttccaacggcggtatcacgacggcgaagggaagtgcttcgtcgttctatggcggtttcagctctttgatcaactacaacgccgccgtgagcagaaatgggcctggtggcgggtttaatgggccagatgcttttggtcttgggcttggtcacgggtcgtattatgaggacgtcagatatgggcaaggaataacggtctggccgttttcaagtggcgctactgatgctgcaactactacaagccacattgctcaaatacccgccacgtggcagtttgaaggtcaagagagcaaagtcgggttcgtgtctggagactacgtagcgtga

SEQ ID NO: 958 - protein, 225 aa, Arabidopsis thaliana
  G1897 polypeptide
MPSEFSESRRVPKIPHGQGGSVAIPTDQQEQLSCPRCESTNTKFCYYNNYNFSQPRHFCKSCRRYWTHGGTLRDIPVGGVSRKSSKRSRTYSSAATTSVVGSRNFPLQATPVLFPQSSSNGGITTAKGSASSFYGGFSSLINYNAAVSRNGPGGGFNGPDAFGLGLGHGSYYEDVRYGQGITVWPFSSGATDAATTTSHIAQIPATWQFEGQESKVGFVSGDYVA

SEQ ID NO: 959 - DNA, 1260 bp, Arabidopsis thaliana
  G1991
atgatagactacgagagaagcaataccaccaagaacatcaacacccatcatcacaaccctcctccatcttcatcttcctctgatcttcttcccgacggtaatggaaccgccgtgactcagaagcggaaacggagacccgccgggacaccggatccggaggcggaggtggtatctttatcaccaagaacgttactagaatcggatcggtacgtatgtgagatctgtaaccaagggtttcaaagggaccagaatctacagatgcatagaagacgacataaagttccatggaagcttcttaaaagagagaccaacgaggaagtgaggaaaagagtctacgtctgtccggagccgacatgtctccaccacaacccttgccacgcgctcggagatctcgtgggaatcaagaaacacttccgacggaaacatagtaaccacaagcaatggatctgcgagcgatgctcaaaaggctacgcagttcaatctgattacaaagctcatctcaaaacctgtggcactcgcggccactcctgtgactgcggccgagttttttccagagtggaaagtttcatagagcaccaagacacttgcaccgtacgccgatcccaaccctccaaccaccgtttacatgagcagcaacaacataccacaaacgctacacaaaccgcttcaaccgcggaaaacaacgagaacggggacctctccattggtcctatattgcctggacatcctttacaaagaagacaatccccaccgtcggaacaacaaccatccactttgctctatcccttcgttactaatggtagtatcgagcttcagctacttccatcgaggaattgtgctgatgagaccagccttagtctgtctatagggacaatggatcaaaagacaatgtcggaagttgagaagaagagctacgagaagggagaaacgagcctagaaagagaggaggcgagaagagaaacaaagaggcagatcgaaatcgcggaattggagtttgctgaagccaagagaataaggcaacatgcgagagctgagcttcacaaagctcatctttttagagaagaagcaagtaggaggattagtgcaacgatgatgcaaataacttgccacaattgcaagcaacattttcaagctccggctgctttggttcctcctcctcctcagacgcattgtaccgatgagagcacgtctctggccgtgagctacatgtcttcggcgactaccgaaggagaaaaggcgagtgatagagcatcttcatag

SEQ ID NO: 960 - protein, 419 aa, Arabidopsis thaliana
  G1991 polypeptide
MIDYERSNTTKNINTHHHNPPPSSSSSDLLPDGNGTAVTQKRKRRPAGTPDPEAEVVSLSPRTLLESDRYVCEICNQGFQRDQNLQMHRRRHKVPWKLLKRETNEEVRKRVYVCPEPTCLHHNPCHALGDLVGIKKHFRRKHSNHKQWICERCSKGYAVQSDYKAHLKTCGTRGHSCDCGRVFSRVESFIEHQDTCTVRRSQPSNHRLHEQQQHTTNATQTASTAENNENGDLSIGPILPGHPLQRRQSPPSEQQPSTLLYPFVTNGSIELQLLPSRNCADETSLSLSIGTMDQKTMSEVEKKSYEKGETSLEREEARRETKRQIEIAELEFAEAKRIRQHARAELHKAHLFREEASRRISATMMQITCHNCKQHFQAPAALVPPPPQTHCTDESTSLAVSYMSSATTEGEKASDRASS

SEQ ID NO: 961 - DNA, 910 bp, Arabidopsis thaliana
  G2216
gtgttcttaatgcagcgagttagcaaatcctttcttcgagttggaagacgagatgcttccttctgctacctctagtaattgttttacttctgcctcaagctttctggctttacctgatcttgaacccatctccattgtgtctcatgaagatatacttagtgtgtatggttctgcttcatggaccgcagaagagacgatgttcgtttctgattttgcgaaaaagagtgaaaccacaactaccaagaagaggagatgcagagaagaatgtttttctagttgttctgtttcaaagacattgtcgaaggaaaccatctcattgtacttttacatgccgataactcaagcggctagagagcttaacattggtttaactcttttgaagaagagatgccgcgaattgggtattaaacgttggcctcatcgtaagctcatgagcctacaaaaactcatcagcaatgtcaaggagctagagaagatggaaggggaagaaaatgaagataagctaagaaacgctttggaaaagctcgagaaggagaagaaaacgattgagaagttaccagatttgaagtttgaggataagacaaagagattgagacaagcttgtttcaaggctaaccataagaggaagagaagaagtggcatgtccacgcccatcacatcatcatcttcttctgcttctgcttcttcttcttcttactcttctgtttcgggttttgagagataataggtgctcgatggtctttgatgaagaggtatgagaagatgatgataaagaggtgaaggatctcttatgaagtttctctagtgtgggttcttctatttgtttgtgaatgtgttgtgtatggtttattgtattcgactctaaattacaaaacgtttttgactcattaatattaaaattactactaat

SEQ ID NO: 962 - protein, 223 aa, Arabidopsis thaliana
  G2216 polypeptide
MLPSATSSNCFTSASSFLALPDLEPISIVSHEDILSVYGSASWTAEETMFVSDFAKKSETTTTKKRRCREECFSSCSVSKTLSKETISLYFYMPITQAARELNIGLTLLKKRCRELGIKRWPHRKLMSLQKLISNVKELEKMEGEENEDKLRNALEKLEKEKKTIEKLPDLKFEDKTKRLRQACFKANHKRKRRSGMSTPITSSSSSASASSSSYSSVSGFER

SEQ ID NO: 963 - DNA, 1617 bp, Arabidopsis thaliana
  G2546
atggcagtttattacacaagtaatgtcggttgttaccagcaagaaccaatctttctcaaccatcaacaacaaaaccaacaagcttcttcttcatccgccgccgcttctttcaccgtcaccggcggcgatactgttcgaaacgagatggtttttatcccaccaaccaccacaggagacgttgtaacaggaaacggtaccgtttcaagcagcgatctaagctttcacgatggtcaaggactgtctttgagccttggtactcagatctctgttgctccgtttcactttcatcaataccaattggggtttactagtcagaatccttcaatttcagtcaaggaaacgtcaccgtttcatgtggatgagatgagtgtgaagagcaaagaaatgatcttgttgggtcaatctgatccttcctctggttatgctggtaatggtgggaatggcttctacaacaattatcggtataatgagacatcaggagggtttatgagcagcgttctgcgttctcggtatcttaaacctgctcagaatttgcttgatgaagtggttagtgtcaagaaagaactaaaccaaatggggaagaagaagatgaaagttaatgactttaacagtggttctaaggagatagaaggaggaggtggtgagttatcgagtgattcgaatgggaaatcgattgagttatctacaattgaacgtgaagagcttcagaacaagaagaacaagcttttaacaatggttgatgaggtagataaaagatataaccaatattaccatcaaatggaagcattagcttcatcatttgagatagtagcaggacttggatcagctaagccttacacatcagttgctctcaacagaatctctcgccattttcgtgctcttcgcgacgcaataaaggaacaaattcagattgttagagaaaaacttggggagaaaggaggagagtcgttggatgagcaacaaggagagaggataccaaggttgaggtatttagatcaacggttgagacagcaaagagctttgcatcaacagcttggaatggttcgacctgcttggagacctcaaagaggtcttcctgaaaactctgtctctgttcttcgcgcttggctctttgaacatttccttcatccatatccgaaagaatctgagaaaatcatgcttgcaaagcagacaggattgtcaaagaaccaggttgctaattggttcataaacgcgagagttcgtctgtggaaaccgatgatcgaagaaatgtataaagaagagtttggtgatgaatctgagttactaatctccaaatcttcccaagaacccaacagcacaaaccaagaagactcctcatcgcagcagcagcagcagcaagagaacaacaacaacagcaacctcgcttattcatctgcagacacaacaaacattgtcttctcatcagaaaccaaaccagatcgtgttctaggcaatgataacgacccacagcaacaacagataaaccgctcatcggattacgacactctgatgaactatcacgggtttggtgttgatgattaccgttacattagcggaagcaaccagcaagaaagcagattctccaattcccatcacttacacgactttgttgtgtga

SEQ ID NO: 964 - protein, 538 aa, Arabidopsis thaliana
  G2546 polypeptide
MAVYYTSNVGCYQQEPIFLNHQQQNQQASSSSAAASFTVTGGDTVRNEMVFIPPTTTGDVVTGNGTVSSSDLSFHDGQGLSLSLGTQISVAPFHFHQYQLGFTSQNPSISVKETSPFHVDEMSVKSKEMILLGQSDPSSGYAGNGGNGFYNNYRYNETSGGFMSSVLRSRYLKPAQNLLDEVVSVKKELNQMGKKKMKVNDFNSGSKEIEGGGGELSSDSNGKSIELSTIEREELQNKKNKLLTMVDEVDKRYNQYYHQMEALASSFEIVAGLGSAKPYTSVALNRISRHFRALRDAIKEQIQIVREKLGEKGGESLDEQQGERIPRLRYLDQRLRQQRALHQQLGMVRPAWRPQRGLPENSVSVLRAWLFEHFLHPYPKESEKIMLAKQTGLSKNQVANWFINARVRLWKPMIEEMYKEEFGDESELLISKSSQEPNSTNQEDSSSQQQQQQENNNNSNLAYSSADTTNIVFSSETKPDRVLGNDNDPQQQQINRSSDYDTLMNYHGFGVDDYRYISGSNQQESRFSNSHHLHDFVV

SEQ ID NO: 965 - DNA, 750 bp, Arabidopsis thaliana
  G2586
atgttctccaacatcgatcaaacagctgtggcagcactcctccgtggccaaggatgcgctaacagtctcaagaggctcctcgaaaaccacaagttaagctcagattcaacagagccgctcatctacaccatactcaattctttctcacttgctctctcttttgtggacccgcctagtcttctaccacacaatgagtcttctcttcaaaacatgacaagtcatgttcttcagagatcatcaaagaaaaaatattatggagcagaagatttagagtattacagagacgaatccccgactccacgccccgatgacggcttcacctggaggaaatatggacaaaaaactatcaaaacctcaccgtaccaaaggtgttactatcggtgtacctatgcaaaagaccaaaactgcaatgctagaaagcgggtgcagatgatccaagataaccctccagtgtacagaactacttatttgggaaaacatgtgtgtaaagctgttgcagttcatgatgatacatatggttctgaaatgataaaattcgaccaagttgtatctgaatcggttatgcctcaactcgcaacaattgacgaacaagcaattaccatggaggacgaagccatagaccatatcatgaaccaagaatgtgatattaatgatttttctgtggatgatgacccattttgggctagtcaatttcctccattttcatcggaagacattatgttttttgacaatattgctaatcttgattag

SEQ ID NO: 966 - protein, 249 aa, Arabidopsis thaliana
  G2586 polypeptide
MFSNIDQTAVAALLRGQGCANSLKRLLENHKLSSDSTEPLIYTILNSFSLALSFVDPPSLLPHNESSLQNMTSHVLQRSSKKKYYGAEDLEYYRDESPTPRPDDGFTWRKYGQKTIKTSPYQRCYYRCTYAKDQNCNARKRVQMIQDNPPVYRTTYLGKHVCKAVAVHDDTYGSEMIKFDQVVSESVMPQLATIDEQAITMEDEAIDHIMNQECDINDFSVDDDPFWASQFPPFSSEDIMFFDNIANLD

SEQ ID NO: 967 - DNA, 765 bp, Arabidopsis thaliana
  G2587
atggtttccaacattgatcacaaggctatggaagcactcctccgtggccaaggatgcgctaacaacctcaagattctccttgaaaacggcgaaataagctcagtttcaacagaaccactcatccacaccattctcgattctttctcacttgctctgtcttttatggattctcctaatcatccaccataccatgaatcctcttctcataacatggcaagtcatatgtcccggagatcatctaagcaagtacaacatcgcagaaaactttgtgtagcagaaggtttagtgaattacaatcacgattcccggactatgtgccccaatgatggcttcacctggaggaaatatggacaaaaaaccattaaagcctcagcgcacaaaaggtgttactatcggtgtacctatgcaaaagaccaaaactgcaatgctacaaagcgggtgcagaagatcaaagacaaccctccagtgtacagaaccacttacttgggaaaacatgtgtgtaaagcttttgcagttcatgatgatacatatagttccacgatgattcgattcgaccaagttgttcctgaaccgattatgccgcagctcacaacaattgaccaccaagtaattaccgtggaggaaaactccgcagaacatatcatgaaccaagaatgtgatattaatgattatttggtggatgatgacccattttgggctagtcaatttcccccgtttccatcgagtgacacaatgttcttggaaaacatttctgcttttgattag

SEQ ID NO: 968 - protein, 254 aa, Arabidopsis thaliana
  G2587 polypeptide
MVSNIDHKAMEALLRGQGCANNLKILLENGEISSVSTEPLIHTILDSFSLALSFMDSPNHPPYHESSSHNMASHMSRRSSKQVQHRRKLCVAEGLVNYNHDSRTMCPNDGFTWRKYGQKTIKASAHKRCYYRCTYAKDQNCNATKRVQKIKDNPPVYRTTYLGKHVCKAFAVHDDTYSSTMIRFDQVVPEPIMPQLTTIDHQVITVEENSAEHIMNQECDINDYLVDDDPFWASQFPPFPSSDTMFLENISAFD

SEQ ID NO: 969 - DNA, 918 bp, Arabidopsis thaliana
  G2635
atgagttcgtctaacggaggtgtaccgcctggttttcggtttcatccaacggacgaagaacttcttcattactacttgaagaagaagatttcttatgaaaagtttgagatggaagtcatcaaagaggttgatttgaacaagattgagccgtgggatttacaagatagatgcaaaataggatcaacgccacaaaatgagtggtatttcttcagccacaaggataggaaatatccgacagggtcaaggacaaaccgtgcaacccactccggtttttggaaggcgacaggacgtgacaaatgcataagaaattcttacaagaagatcggcatgaggaagactcttgtattctacaaaggaagagctcctcatggccaaaagacagattggatcatgcacgagtaccgtatcgaagacactgaagatgacccttgtgaagatggatgggttgtttgtagagtgttcaagaagaaaaatctgttcaaagtagggaatgatgttggctcaaacatcagcaataataggcttgaagctcgtagtttcatccgaagagaaagcccttaccaaggaatctcaatgtttgagcttaacaagcctgaagagattagtgttcatcaatatcctcaaccaccaatgtttcaacctcatcacaagcctctttcaataggctatgactattcattggctcttctaccaagagaaagcgagtaccaacaagcgtgtcagccatcaggggttgaggttggcacgtgcaaggcagtaagtgaatggggaatagtgaattgtaacatggtgagtcatgaggactcgtctagagcgatgaggtttgaagatgacggtaacaacacttcttccacggtccagccaccttctaatctgctttcattgcgcggtgaaaatggatttcttgggttgttttaa

SEQ ID NO: 970 - protein, 305 aa, Arabidopsis thaliana
  G2635 polypeptide
MSSSNGGVPPGFRFHPTDEELLHYYLKKKISYEKFEMEVIKEVDLNKIEPWDLQDRCKIGSTPQNEWYFFSHKDRKYPTGSRTNRATHSGFWKATGRDKCIRNSYKKIGMRKTLVFYKGRAPHGQKTDWIMHEYRIEDTEDDPCEDGWVVCRVFKKKNLFKVGNDVGSNISNNRLEARSFIRRESPYQGISMFELNKPEEISVHQYPQPPMFQPHHKPLSIGYDYSLALLPRESEYQQACQPSGVEVGTCKAVSEWGIVNCNMVSHEDSSRAMRFEDDGNNTSSTVQPPSNLLSLRGENGFLGLF

SEQ ID NO: 971 - DNA, 996 bp, Arabidopsis thaliana
  G2639
atggcaggatttttctcgttaggacacggcggaggaggaaacactccagacaaccacagaacaaacactaataatccttcttcatcgggaacagaatcttggctttggtgcagaaaccctaactctaacgctgacggtggagaagctggtccttcttacaaaggaacccttgagctatggcaacacccaaacaatcaagaaatcattttccagcagcagcagcaacagcaacaaaggctggatctttacacttccgctgcgggtttaggtgttggaccgagcaaccggagcttaattgaaacttccggcggtgcgttgatgatgatgagaagcggtagcggtagcggcggaccaagctgccaggattgtgggaatcaatctaagaaagactgctctcacatgagatgtaggacttgctgcaagagccgtggccttgactgtcccactcacgtgaagagcacgtgggttcctgccgctaaacgccgagaacgccagcagcagctttctaccggtcagcaaccgcagcaactgggagggagcgtccctaaacgacagagagagcgtatcccggcgagatcgacttccatggcctacactcgtataccttctaacaacacttcagggttggaggttgggaattttccgccggaagttagctcgtcggcagtttttcggtgcgtgcgtgtgagttccgtagatgatgaagaagaagagtatgcatataaaacagctgtgagtataggcggtcacgtcttcaaaggtgttctctacgatcaaggcccggccgagagaagctcctcgggcggtggatctcagccgttgaatctcataaccgcaggcccatcggcctcatcatcaagcccaaacgtgagctgcaacaatggagtcgttggctccacttcagatcattatatcgatcctgcctcacttaattatcctactcccattaacactttcatgactggtacgcacttcttctccaactcaagatcttga

SEQ ID NO: 972 - protein, 331 aa, Arabidopsis thaliana
  G2639 polypeptide
MAGFFSLGHGGGGNTPDNHRTNTNNPSSSGTESWLWCRNPNSNADGGEAGPSYKGTLELWQHPNNQEIIFQQQQQQQQRLDLYTSAAGLGVGPSNRSLIETSGGALMMMRSGSGSGGPSCQDCGNQSKKDCSHMRCRTCCKSRGLDCPTHVKSTWVPAAKRRERQQQLSTGQQPQQLGGSVPKRQRERIPARSTSMAYTRIPSNNTSGLEVGNFPPEVSSSAVFRCVRVSSVDDEEEEYAYKTAVSIGGHVFKGVLYDQGPAERSSSGGGSQPLNLITAGPSASSSSPNVSCNNGVVGSTSDHYIDPASLNYPTPINTFMTGTHFFSNSRS

SEQ ID NO: 973 - DNA, 522 bp, Arabidopsis thaliana
  G2642
atggatatgaacatggagaagatttttgaggattcagttccttgtagggttcgtgctaaacgtggttgtgctactcatcctcgtagcattgctgaacgggctgcgatgatgatgattcgtagtggtggcagcggaggaagtggtggtgtgagctgtcaagactttgggaatcaagcgaagaaagattgctctcacatgaggtgtagaacttgttgtaagagccgtggcttcgagtgttctactcacgtgagaagcacgtgggttcctgctactaaacgccgtgagagacaacaacaattagctacggttcagcctcaaactcagctgcctcgcggtgagagcgttcctaaacgccaccgtgagaatttaccggcaacttcatcgtctctagtctgcactcgcataccttttcattcaggtatatgtcactgcaatgtgaaatatttatttatgtgtatatatatatgtttattattatatggtcgtgagatatataatgaaatgcaagcagcatttttataa

SEQ ID NO: 974 - protein, 173 aa, Arabidopsis thaliana
  G2642 polypeptide
MDMNMEKIFEDSVPCRVRAKRGCATHPRSIAERAAMMMIRSGGSGGSGGVSCQDFGNQAKKDCSHMRCRTCCKSRGFECSTHVRSTWVPATKRRERQQQLATVQPQTQLPRGESVPKRHRENLPATSSSLVCTRIPFHSGICHCNVKYLFMCIYICLLLYGREIYNEMQAAFL

SEQ ID NO: 975 - DNA, 294 bp, Arabidopsis thaliana
  G2721
atggcgtcaaactcaagaagttcaatctcaccatggacgtttagtcaaaacaagatgttcgagagggccttggcagtttacgacaaggacacacccgaccgatggcacaatgtggcaaaagctgtcggagggaaaactgtagaagaagtgaagcgccactatgacattctcgtcgaggatctcatcaacatcgagactggtcgtgtccctttgcccaattacaagaccttcgaatctaactcaagaagcatcaatgactttgacacaaggaaaatgaagaatttgaagatctaa

SEQ ID NO: 976 - protein, 97 aa, Arabidopsis thaliana
  G2721 polypeptide
MASNSRSSISPWTFSQNKMFERALAVYDKDTPDRWHNVAKAVGGKTVEEVKRHYDILVEDLINIETGRVPLPNYKTFESNSRSINDFDTRKMKNLKI

SEQ ID NO: 977 - DNA, 735 bp, Arabidopsis thaliana
  G2826
atggaggagctggattttagttcaaaaacaacaacttctcgtctaaagctatttggatttagtgttgatggagaagaagatttctccgatcaatcagtcaaaactaacctatcttctgtatcaccggaacgtggcgagtttccggcaggatcttccggaagaagtggcggtggtgtacgaagccgaggcggaggaggaggaggaggagaacgtaagtatgagtgtcagtattgttgtagagagtttggtaactcacaagccttaggtggtcaccaaaacgctcacaagaaagagcgtcaacagcttaaacgtgctcagcttcaagctacacgaaacgcagccgcaaatttctcaaacgctggatcagcgtctcagtttttaaggaatcctatagtctctgcttttgctcctccgcctcatcttttatcatcatccgccgtgcctcagcctatgggaggtccttggatgtatcttccacgtgtttctccatctcaacttcacgtgtctcatggctgcgtcatccaagatggttcgggtggtgcgggtgctggtgggttctcgtacgagtatggggctcgtgattcagggtttggagtagttggggctcagatgagacatgttcaggcccatgggccgagaccatcggttaatgggttttcaagagaagtaggaactacttttgatgatggtttagggttggatttgcatctcagtcttgcacctgctggtcattga

SEQ ID NO: 978 - protein, 244 aa, Arabidopsis thaliana
  G2826 polypeptide
MEELDFSSKTTTSRLKLFGFSVDGEEDFSDQSVKTNLSSVSPERGEFPAGSSGRSGGGVRSRGGGGGGGERKYECQYCCREFGNSQALGGHQNAHKKERQQLKRAQLQATRNAAANFSNAGSASQFLRNPIVSAFAPPPHLLSSSAVPQPMGGPWMYLPRVSPSQLHVSHGCVIQDGSGGAGAGGFSYEYGARDSGFGVVGAQMRHVQAHGPRPSVNGFSREVGTTFDDGLGLDLHLSLAPAGH

SEQ ID NO: 979 - DNA, 998 bp, Arabidopsis thaliana
  G2838
cgggaattaaatgcaagaaacatagaggagaccgtacttcgaagttgcaaatttaacactaagttgaagaatctagaaatagaaagccaaaatcttcctttacttcaactctacaatttcaatcttttctctgtacttagccatccagagtcataaccaccactatattaaaatgaagacttatgatttcatgaacgtcaactctttctctcctaaggaaagacccattcgcctctttggcttcgagtttggagcttctcatgaagaatctgagtccaaagacaattacaacgagaacaatgaaagcatcaaagacgataacaaagaaaaaagattcaagtgccactattgtttccggaacttccctacttcacaagccctaggcggccatcaaaacgctcacaagagagaacgtcaacaaactaaacgcttcaacctccattcaaacgcagccgctttcttccaccgccaacaaaaccacattgctgcttctaggctctacgaggatcgctatagccttgaagctgttcaaatcaacgacgcgagattagggttatgtcgtatgtataactcatctgcgagttttaatcgtgaccgttcatcttattataatagatatattccttggttcatcggtgatcaccagactagaccaacgtatgtcggtggtggtagcagcagccatggtctgttttacgagtccaagaagaatgtaccggaccacgtgagtttggatctacgcctctagttccattcttttagtatctctctctagctagttcttaaaaaaaaaaaaagagagactagttttttttccttctttcaaatactttttattttattttagtctacttgattaattatgaatttatgatagtgtatccccgtagatatcatgttatattaacagttaaacaattttatggagatgaactttaacttcagatagtttctttctgagatttaaagtcttaaatattatcgacgcattccaatct

SEQ ID NO: 980 - protein, 191 aa, Arabidopsis thaliana
  G2838 polypeptide
MKTYDFMNVNSFSPKERPIRLFGFEFGASHEESESKDNYNENNESIKDDNKEKRFKCHYCFRNFPTSQALGGHQNAHKRERQQTKRFNLHSNAAAFFHRQQNHIAASRLYEDRYSLEAVQINDARLGLCRMYNSSASFNRDRSSYYNRYIPWFIGDHQTRPTYVGGGSSSHGLFYESKKNVPDHVSLDLRL

SEQ ID NO: 981 - DNA, 519 bp, Arabidopsis thaliana
  G2866
atgggaagagggagaagctcatcgtcttcatcgatagagagcagctgcaaaagcaacccatttggtgtgtcttcgagtaatactcggaacctaagcacggacctgagactcgggctcagcttcggatcatcttccggacaatattacaacggtggagataaccatgaatatgatggagtcggtgcggcagaggaaatgatgatcatggaagaagaagagcaaaacgagtgtaatagtgtcggaagcttctacgtgaaagtgaacatggaaggagttcctattgggagaaagatcgatcttttatctcttaatggatatcatgatttgatcacaactctcgactacatgttcaatgcttcaatcctttgggctgaagaagaagatatgtgtagtgagaagagtcacgtgctaacgtacgcagacaaagaaggtgactggatgatggttggagatgttccttgggagatgttcttgtctagcgtgagaagactaaagatctcaagagcttatcactactga

SEQ ID NO: 982 - protein, 172 aa, Arabidopsis thaliana
  G2866 polypeptide
MGRGRSSSSSSIESSCKSNPFGVSSSNTRNLSTDLRLGLSFGSSSGQYYNGGDNHEYDGVGAAEEMMIMEEEEQNECNSVGSFYVKVNMEGVPIGRKIDLLSLNGYHDLITTLDYMFNASILWAEEEDMCSEKSHVLTYADKEGDWMMVGDVPWEMFLSSVRRLKISRAYHY

SEQ ID NO: 983 - DNA, 823 bp, Oryza sativa
  G3503
cttccactgaaacaacccaccgaggcagcagaagaaaggaaagaatcaagaaagcttcatcgtcttcatggggaggtcaccgtgctgcgagaaggcacacaccaacaagggagcatggaccaaggaggaagatgaccggctcattgcctacatcaaggcgcacggcgaaggttgctggcgatcgctgcccaaggccgccggcctcctccgctgtggcaagagctgccgcctccggtggatcaactacctccggcctgacctcaagcgcggcaacttcaccgaggaggaggatgagctgatcatcaagcttcacagccttttaggcaacaaatggtctctgatagccgggaggttgccaggaagaacggacaacgagatcaagaactactggaacacgcacatcaggaggaagctgctgagccgtggcatcgacccggtgacacaccggccgatcaacgacagcgcgtccaacatcaccatatcattcgaggcggccgcggcggcggcgagggacgacaaggccgccgtgttccggcgagaggaccatcctcatcagccgaaggcggtgacagtggcacaggagcagcaggcagccgccgattggggccatgggaagccactcaagtgccctgacctcaatctggacctctgcatcagcctcccttcccaagaagagcccatgatgatgaagccggtgaagagggagaccggcgtctgcttcagctgcagcctggggctccccaagagcacagactgcaagtgcagcagcttcctgggactcaggacagccatgctcgacttcagaagcttggaaatgaaatga

SEQ ID NO: 984 - protein, 251 aa, Oryza sativa
  G3503 polypeptide
MGRSPCCEKAHTNKGAWTKEEDDRLIAYIKAHGEGCWRSLPKAAGLLRCGKSCRLRWINYLRPDLKRGNFTEEEDELIIKLHSLLGNKWSLIAGRLPGRTDNEIKNYWNTHIRRKLLSRGIDPVTHRPINDSASNITISFEAAAAAARDDKAAVFRREDHPHQPKAVTVAQEQQAAADWGHGKPLKCPDLNLDLCISLPSQEEPMMMKPVKRETGVCFSCSLGLPKSTDCKCSSFLGLRTAMLDFRSLEMK

SEQ ID NO: 985 - DNA, 763 bp, Oryza sativa
  G3504
gacgactcgccgccggcctagaccaacagcgatggggaggtcgccgtgctgcgagaaggagcacactaacaagggcgcgtggaccaaggaggaggacgagcgcctcgtcgcctacatccgcgcccacggcgagggctgctggcgctcgctccccaaggccgccggcctcctccgctgcggcaagagctgccgcctccgctggatcaactacctccgccccgacctcaagcgcggcaacttcaccgccgacgaggacgacctcatcatcaagctccacagcctcctcggcaacaagtggtctctgatcgcggcgaggctgccggggaggacggacaacgagatcaagaactactggaacacgcacatccgccggaagcttctcggcagggggatcgaccccgtcacgcaccgccccgtcaacgccgccgccgccaccatctccttccatccccagccgccgccaacgacgaaggaggagcagctcatactcagcaagccgcccaagtgccccgacctcaacctggacctctgcatcagcccgccgtcgtgccaggaagaagacgatgactatgaggcgaagccggcgatgatcgtgagggcgccggagctgcagcgccgccgcggcggcctctgcttcggctgcagcctcggcctccagaaggagtgcaagtgcagcggcggcggcgccggcgccggcgccggcaacaacttcctcggcctcagggctggcatgctcgacttcagaagcctccccatgaaatga

SEQ ID NO: 986 - protein, 243 aa, Oryza sativa
  G3504 polypeptide
MGRSPCCEKEHTNKGAWTKEEDERLVAYIRAHGEGCWRSLPKAAGLLRCGKSCRLRWINYLRPDLKRGNFTADEDDLIIKLHSLLGNKWSLIAARLPGRTDNEIKNYWNTHIRRKLLGRGIDPVTHRPVNAAAATISFHPQPPPTTKEEQLILSKPPKCPDLNLDLCISPPSCQEEDDDYEAKPAMIVRAPELQRRRGGLCFGCSLGLQKECKCSGGGAGAGAGNNFLGLRAGMLDFRSLPMK

SEQ ID NO: 987 - DNA, 1042 bp, Oryza sativa
  G3505
ctgtacccccgccgcggctcacctggaaactgggcagattggacaatcgctcgagcgagctagcgagagagagcgcgagagagcgaggcggcgcgcgcggtggttgcggatttgtagcttagagcgcggggccatggggaggtcgccgtgctgcgagaaggcgcacacgaacaagggggcgtggacgaaggaggaggaccagcggctcatcgcgtacatcagggcgcatggcgaaggctgctggcgctcgctgcccaaggcggcgggcctccttcgctgcggcaagagctgccgcctccggtggatgaactacctccgccccgacctcaagcgcggcaacttcaccgacgacgaggacgagctcatcatccgcctccacagcctcctcggcaacaagtggtctctgatcgccgggcagctgccggggaggacggacaacgagatcaagaactactggaacacgcacatcaagcgcaagctcctcgcccgcggcatcgacccgcagacgcaccgcccgctgctcagcggcggtgacggcatcgcggcgagcaacaaggcggcaccaccgccgccgcatcccatatccgtcccggcgaaggcggcggccgcggcgatcttcgccgtggcgaagccgccgccgccgccgcgcccggtcgactcctcggacgacggctgccgcagcagcagcggcacaacgagcacgggggagccgcggtgccccgacctcaacctcgagctctcggtcgggccgacgccgagctcgccgccggcggagacgcccaccagcgcgcggccggtctgcctctgctaccacctcggcttccgcggcggggaggcgtgcagctgtcaggctgacagcaagggcccacacgagtttagatatttcaggccgttggaacaaggccagtacatatgagatatgaccatgagatgtgagatggcttaattagcttcaattcccaacatgtgtaacacagggagtttttctagtggacgacaatactgtttaatttcagaaaaaaaagggaaagaaaaaggttct

SEQ ID NO: 988 - protein, 260 aa, Oryza sativa
  G3505 polypeptide
MGRSPCCEKAHTNKGAWTKEEDQRLIAYIRAHGEGCWRSLPKAAGLLRCGKSCRLRWMNYLRPDLKRGNFTDDEDELIIRLHSLLGNKWSLIAGQLPGRTDNEIKNYWNTHIKRKLLARGIDPQTHRPLLSGGDGIAASNKAAPPPPHPISVPAKAAAAAIFAVAKPPPPPRPVDSSDDGCRSSSGTTSTGEPRCPDLNLELSVGPTPSSPPAETPTSARPVCLCYHLGFRGGEACSCQADSKGPHEFRYFRPLEQGQYI

SEQ ID NO: 989 - DNA, 1037 bp, Oryza sativa
  G3506
aaaagctattactactagtacaaaaccaacgcgaagctctcgtcgcgcacaaccaactcgacaccgcggcgaggcgaaccaacgcgcggcgtgggcatggggaggtcgccatgctgcgagaaggcgcacacgaacaagggggcgtggacgaaggaggaggaccagcggctgatcgcctacatcaaggcgcacggcgagggttgctggcggtcgctgcccaaggcggcggggctcctccgctgcggcaagagctgccgcctccgctggatgaactacctccgccccgacctcaagcgcggcaacttcaccgacgacgacgacgagctcatcatcaagctccacgcccttctcggcaacaagtggtcgttgattgcggggcagctgccggggaggacggacaacgagatcaagaactactggaacacgcacatcaagcgcaagctcctgagccggggcatcgacccgcagacgcaccggccggtcagcgccgggagcagcgccgccgcggcgagcgggctgaccacgacggccagcaccgccgcctttccgtcccttgcgccggcgccgccgccgcagcagcacaggctacacaacccggtgcacgccgcggcgccgagcaatgcgagcttcgccaggtccgcggcgtccccgccgtcggaggacggccacagcagcagcggcggcagctcggacgcgccgcggtgccccgacctcaacctcgacctcgacctcgacctgtccatgagcctgccgagctcgccgcccaagacgccggccgccgcgtcgtccacgaccgcgtcgcgccaccatcaccaccagcagcagaagaccatctgcctctgctaccacctcggcgtccgcaacggcgacgtctgcagctgcaaggcggccgcgccatcgccggccggcccacgcgcgttccggtttctcaggccactggaggagggccagtacatatagcacagcaggctttagggaaaaaaaacctgtaaaaaacacaaaaaaaaacggtgggcaatagagttttttctaagttc

SEQ ID NO: 990 - protein, 287 aa, Oryza sativa
  G3506 polypeptide
MGRSPCCEKAHTNKGAWTKEEDQRLIAYIKAHGEGCWRSLPKAAGLLRCGKSCRLRWMNYLRPDLKRGNFTDDDDELIIKLHALLGNKWSLIAGQLPGRTDNEIKNYWNTHIKRKLLSRGIDPQTHRPVSAGSSAAAASGLTTTASTAAFPSLAPAPPPQQHRLHNPVHAAAPSNASFARSAASPPSEDGHSSSGGSSDAPRCPDLNLDLDLDLSMSLPSSPPKTPAAASSTTASRHHHHQQQKTICLCYHLGVRNGDVCSCKAAAPSPAGPRAFRFLRPLEEGQYI

SEQ ID NO: 991 - DNA, 1027 bp, Oryza sativa
  G3507
ttcctcctctccactctccaccatcgtcttcgtcgtcgtcttcctcagctcggagcgatggggaggtcgccgtgctgcgagaaggcgcacacgaacaagggcgcgtggaccaaggaggaggaccagcgcctcatcgcccacatcaaccagcacggcgagggctgctggaggtcgctccccaaggccgccgggttgctgcgttgcgggaagagctgccgcctccggtggatcaactacctccgccccgacctcaagcgcggcaacttcaccgacgaggaagacgagctcatcatcaagctccacgagctcctcggcaacaagtggtcgctgatcgccgggaggctgccggggaggacggacaacgagatcaagaactactggaacacccacatcaagcgcaagctcctcgcccgcggcctcgacccgctcacgcaccgcccgctcaatgccgccgccgccgtcgccggccaccaccacctcgccgccggcggctccagctgctcgcccgacgcaacaagcggccacagcagctgcagcgacggcgacgagtaccgcggcggcatcgacctcaacctgtccataagcccgccgtcgtcgtcgtcccagccgtcttccccgccgccgccgccgcacgaagcagaggcgagacgcgccggagcgacggcgagctacacctaccaccaccactactcggagacgagggagaagatatgcctgtgcttgaaccacctcgggctgcacggcggcgacgagtgcagctgcggcggctcgtcggcctcttcctcctcctcgccgccgccggcgacggcgagctcgcgagcgttcacattcgccaatgcatcgtcgtcaacagtgtaaaacacagagaaattcagcgattttcagactaagagaattaatgagaggtagagcacatgcatgctgaattaattgaattaactcaatccaagcttgagctaggcatctagctaactttgtgatttgatcatgatcagctagcaaaatcatcataatcatcatcatcatc

SEQ ID NO: 992 - protein, 266 aa, Oryza sativa
  G3507 polypeptide
MGRSPCCEKAHTNKGAWTKEEDQRLIAHINQHGEGCWRSLPKAAGLLRCGKSCRLRWINYLRPDLKRGNFTDEEDELIIKLHELLGNKWSLIAGRLPGRTDNEIKNYWNTHIKRKLLARGLDPLTHRPLNAAAAVAGHHHLAAGGSSCSPDATSGHSSCSDGDEYRGGIDLNLSISPPSSSSQPSSPPPPPHEAEARRAGATASYTYHHHYSETREKICLCLNHLGLHGGDECSCGGSSASSSSSPPPATASSRAFTFANASSSTV

SEQ ID NO: 993 - DNA, 888 bp, Oryza sativa
  G3508
atggggaggtccccatgctgcgagaaggcgcacacgaacaagggagcctggacgaaggaggaggaccagcggctcatcgcctacatcaaggccaacggcgagggatgctggaggtcgctccccaaggccgcagggttgctgcggtgcgggaaaagctgccggctgcgatggatcaactacctgagaccggacctcaagcgaggtaatttcaccgaggaggaggacgagttcatcatcaagctccatgagcttctaggcaacaagtggtcactgatcgccgggaggctgccggggaggacggacaacgagatcaagaactactggaacacgcacatcaagcgcaagctcctcgcccgcggcgtcgacccgcagacgcaccgcccgctcaatgccgccgccgaccaccaccagcagcagcagctccaggcgccacggcggttcgccgccgcgccagccggccaccaccaccaccaccctgaccatttcgccgtcctctccaactcgccggaggcctgcagccacagcagcgacgacgagcccagctccgccacgccgccgccgccgccgcgtcacctcggcatcgacctcaacctttccatcagcctagctccttaccagccgcaggatcagaccagcgagccgatgaagcaggaggaggacgacgaagcgtcagcgacggcgaacggcgccggcaatgcagcgatgacgacgacggcgacgacggcggcggtgtgcctgtgcttgaaccgcctcgggctccacggcggcgaggtgtgcagctgcggacgcggcggcgccccctccatgcaggccagcacacacatgtttagattcatcacgccgctaggaggaagccaccacaacagtagtagcacaacaatgacataa

SEQ ID NO: 994 - protein, 295 aa, Oryza sativa
  G3508 polypeptide
MGRSPCCEKAHTNKGAWTKEEDQRLIAYIKANGEGCWRSLPKAAGLLRCGKSCRLRWINYLRPDLKRGNFTEEEDEFIIKLHELLGNKWSLIAGRLPGRTDNEIKNYWNTHIKRKLLARGVDPQTHRPLNAAADHHQQQQLQAPRRFAAAPAGHHHHHPDHFAVLSNSPEACSHSSDDEPSSATPPPPPRHLGIDLNLSISLAPYQPQDQTSEPMKQEEDDEASATANGAGNAAMTTTATTAAVCLCLNRLGLHGGEVCSCGRGGAPSMQASTHMFRFITPLGGSHHNSSSTTMT

SEQ ID NO: 995 - DNA, 1152 bp, Lycopersicon esculentum
  G3509
cacaacaaagccaaaaaaacttccattatccttctctcaattggtatatcacacttgcaaaaaccaaaaaaaataaaggtatagtttcttaaatactcttatttgtctaaatgggaaggtcaccttgttgtgagaaggcacatacaaacaaaggagcatggactaaagaagaagatgaaagactaatttcttacattagagctcatggtgaaggttgttggaggtctcttcctaaagctgctggacttcttcgatgcggtaaaagttgtcgtctccgatggattaattacttaagacctgaccttaaacgtggtaactttactgaagaagaagatgaactcattatcaaactccatagcctccttggaaacaagtggtcgcttatagcaggaagattaccaggaagaacagataacgagataaaaaactattggaacacacatataagacgaaagctcttgagtcgaggtattgatccaacaacacatagatcaatcaatgatcctactacaataccaaaagttacaacgattacttttgctgctgctcatgaaaatattaaagatattgatcaacaagatgagatgataaatatcaaagctgaattcgttgaaacaagcaaagaatcagataataatgaaataattcaagaaaagtcatcatcatgtcttcctgacttaaatcttgaactcagaattagtcctccacatcatcaacaactcgatcatcatcgtcatcatcaacgatcaagctctttatgttttacatgtagtttgggaattcaaaatagtaaagattgcagttgtggaagtgaaagtaatggaaatggatggagtaataatatggtaagtatgaacattatggctggttatgactttttgggcttgaagactaatggtcttttggactatagaactttggaaactaagtgattcgattcgattcgaatttatgcataaatcatcttaatttgatgtatatgtagaaaagaaaaagagtttgaggatattatttcttctagctaataattttctcatggttgtaaactttgcaatatagtaattacatttaattcaaagcagtaaaaatatagcactaatgattctatgaagataatttttctttttcctctaaaaaaaaaaaaaaaaaaaa

SEQ ID NO: 996 - protein, 273 aa, Lycopersicon esculentum
  G3509 polypeptide
MGRSPCCEKAHTNKGAWTKEEDERLISYIRAHGEGCWRSLPKAAGLLRCGKSCRLRWINYLRPDLKRGNFTEEEDELIIKLHSLLGNKWSLIAGRLPGRTDNEIKNYWNTHIRRKLLSRGIDPTTHRSINDPTTIPKVTTITFAAAHENIKDIDQQDEMINIKAEFVETSKESDNNEIIQEKSSSCLPDLNLELRISPPHHQQLDHHRHHQRSSSLCFTCSLGIQNSKDCSCGSESNGNGWSNNMVSMNIMAGYDFLGLKTNGLLDYRTLETK

SEQ ID NO: 997 - DNA, 1096 bp, Glycine max
  G3527
ggccactctctctctttaacctgcctcaccaactcgcatctagaagcaattatagggtctttctctcttctctctctatgttctgtcccctctactttggagtcaaaagcctataaaaccacacccaaacttcctcttgagccggcttcttaatttgttgctgcaagccaatcctaattcctattctcctatccttttacataactctaaagtaagaaaaaatagagcaatttcacaacacaactcttagaattgtgagttaagtatgggaaggtccccttgctgtgagaaagctcacacaaacaaaggtgcatggactaaagaagaagatgacagactcatatcttatattcgagctcacggagaaggctgctggcgttcactccccaaagccgccggccttctccggtgcggcaagagctgccgtctccggtggatcaactacctccgccccgacctcaaaagaggtaactttaccgaagaagaagatgaactcatcatcaaactccacagtctcctcggtaacaagtggtctttgatagctggaagattgccggggagaacagacaatgaaataaagaattattggaacacgcacataagaaggaagcttttgaacagaggaatcgaccctgctactcataggccactcaacgaagctgcttctgctgcaactgttacaactgccaccactaatatatcttttgggaaacaacaagaacaagagacaagttctagtaacggaagcgttgttaaaggttccatcttggaacgctgccctgacttgaaccttgagttaaccattagtcctcctcgccaacaacaacctcagaagaatctttgttttgtttgcagtttgggtttgaacaacagcaaggattgtagctgcaacgttgccaacactgttactgttactgtcagcaacactactccttcttctgctgctgctgctgctgctgctgcttatgatttcttgggcatgaaaaccaacggtgtttgggattgcacccgcttggaaatgaaatgaaaattcaacgaaattataccaattagttagtgtttttggagagaagtcgagagaatgaaattcattaat

SEQ ID NO: 998 - protein, 253 aa, Glycine max
  G3527 polypeptide
MGRSPCCEKAHTNKGAWTKEEDDRLISYIRAHGEGCWRSLPKAAGLLRCGKSCRLRWINYLRPDLKRGNFTEEEDELIIKLHSLLGNKWSLIAGRLPGRTDNEIKNYWNTHIRRKLLNRGIDPATHRPLNEAASAATVTTATTNISFGKQQEQETSSSNGSVVKGSILERCPDLNLELTISPPRQQQPQKNLCFVCSLGLNNSKDCSCNVANTVTVTVSNTTPSSAAAAAAAAYDFLGMKTNGVWDCTRLEMK

SEQ ID NO: 999 - DNA, 1172 bp, Glycine max
  G3528
ctttaacctgtctcaccaactcgcatctagaagcaattagggtctcccttttctctctatgtctcctttggagtcaaaagcctataaaaccacacccaaactccctcttgagccggcttcttaaatatttgttgctgcaagctagccaatcctaattcctattcctatccttattactacataactctaaagtaagtaagaaaaatagagcaatttcacaacacaacacaactcttataattgtgtgagttattaattgagtatgggaaggtccccttgctgtgagaaagctcacacaaacaaaggtgcatggactaaagaagaagatgacagactcatatcttatattcgagctcacggcgaaggctgctggcgttcactccccaaagccgccggtcttctccggtgcggcaaaagctgccgtctccggtggatcaactacctccgccccgaccttaaaagaggtaactttaccgaagaagaagacgagctcatcatcaaactccacagtctcctcggtaacaagtggtctttgatagctggaagattgccggggagaacagacaatgaaataaagaactattggaatacgcacataagaaggaagcttttgaacagaggaatcgaccctgcaactcataggccactcaacgaagctgcaactgctgcaactgttacaactaatatatcttttggcaaacaagaacaacaagagacaagttcgagtaacggaagcgttgttaaaggttccatcttggaacgctgccctgacttgaaccttgagttaaccattagtcctcctcgccaacaacaacagactcagaagaatctttgtttcgtttgcagtttgggtttgcacaacagcaaagattgcagctgcaacgtttccaacgctgtcactgtcaacaacaccactccttcttctgctgctgctgctgcttatgatttcttgggcatgaaaaccagcggtgtttgggattgcacccgcttggaaatgaaatgaaaattcaaccaaattatatcaattagttagtgttgttggagagaagtgagagaatgaaattcgttaatttttgaattttctctcctattttttcttttttttcttctcttatttgtataaataattagtcgctgatatgcataatatatagtaacggtacagttgaaca

SEQ ID NO: 1000 - protein, 246 aa, Glycine max
  G3528 polypeptide
MGRSPCCEKAHTNKGAWTKEEDDRLISYIRAHGEGCWRSLPKAAGLLRCGKSCRLRWINYLRPDLKRGNFTEEEDELIIKLHSLLGNKWSLIAGRLPGRTDNEIKNYWNTHIRRKLLNRGIDPATHRPLNEAATAATVTTNISFGKQEQQETSSSNGSVVKGSILERCPDLNLELTISPPRQQQQTQKNLCFVCSLGLHNSKDCSCNVSNAVTVNNTTPSSAAAAAYDFLGMKTSGVWDCTRLEMK

SEQ ID NO: 1001 - DNA, 866 bp, Glycine max
  G3529
gtggagagcataggatgggaaggtccccttgctgtgagaaagcacacacaaacaaaggtgcatggaccaaagaagaagatcatcgcctcatttcttacattagagctcacggtgaaggctgctggcgctctctccccaaagccgccggccttctccgttgcggcaagagctgtcgtctccgctggatcaactatctccgccctgacctcaagcgcggcaatttctccctcgaagaagaccaactcatcatcaaactccacagcctccttggcaacaagtggtctctaattgctggtagattgcccggtagaactgacaatgagatcaagaattactggaatactcacatacgcaggaagcttctgagcagaggtattgaccctgccactcacaggcctctcaacgattcttctcatcaagaacctgctgctgtctctgcccctcctaaacatcaagagtcctttcaccatgaacgctgccctgacttgaaccttgagctaaccattagtcctccccatcatcctcaacctgatcatccgcacttgaagacccttgtgacaaactcaaacctttgctttccctgcagtctgggtttgcataatagcaaagattgtagctgtgccctccacactagtactgccaacgctactgctactggctatgatttcttggccttgaaaaccaccgtcgttttggattacagaaccttgcacatgaaatgaaatcatattactgaaatctctctctttctttctttctttcttttcttctctaatataatttcttacttacttacttacttacttacttacttgttaatggttgcaaatgataaaaaagttccagccagtacagttgaacaaaaa

SEQ ID NO: 1002 - protein, 235 aa, Glycine max
  G3529 polypeptide
MGRSPCCEKAHTNKGAWTKEEDHRLISYIRAHGEGCWRSLPKAAGLLRCGKSCRLRWINYLRPDLKRGNFSLEEDQLIIKLHSLLGNKWSLIAGRLPGRTDNEIKNYWNTHIRRKLLSRGIDPATHRPLNDSSHQEPAAVSAPPKHQESFHHERCPDLNLELTISPPHHPQPDHPHLKTLVTNSNLCFPCSLGLHNSKDCSCALHTSTANATATGYDFLALKTTVVLDYRTLHMK

SEQ ID NO: 1003 - DNA, 920 bp, Zea mays
  G3531
ccacgcgtccggtgccctataaaatccagccccgcttggcttcacccacccttgggctcgcagtcgcagcaacgatggggaggtcgccgtgctgcgagaaggcgcacacgaacaagggcgcgtggaccaaggaggaggacgaccgtctggtggcgtacatcaaggcgcacggcgaggggtgctggcgctcccttcccaaggccgccggacttgtgcgctgcggcaagagctgccgcctccggtggatcaactacctgcggcccgacctcaagcgcggcaacttcacggaggaggaggacgagctcatcatcaagctccacagcctactcggcaacaaatggtccctgatcgctggaaggctgccgggcaggaccgacaacgagatcaagaactactggaacacgcacatccggcggaagctgctgagcagggggatcgacccggtgacacaccgccccatcaacgagcacacgtccaacataaccatatcgttcgaggactggggccaggggaaggcgctcaagtgccccgacctgaacctggacctctgcatcagcccgccgtgccaggaggaggaggaggccatgctgctgaggccggtgaagcgggaggaggccgggctctgcttcagctgcagcctggggctccccaagagcgcggactgcaagtgcagcaacttcctcgggctcaggaccgccatgctcgacttcagaagactcgagatgaaatgagagcttccatccatctctgtctgtctctctctgtaacttcacccctgataacacgcagtagtagtagtcaccaactgatttgtcgcaacattctgtctctctctctctctctctctctctctctctctctctctcgctatgtaaattagcatcaccaactgattgatcatgggcaattaataataaaaa

SEQ ID NO: 1004 - protein, 218 aa, Zea mays
  G3531 polypeptide
MGRSPCCEKAHTNKGAWTKEEDDRLVAYIKAHGEGCWRSLPKAAGLVRCGKSCRLRWINYLRPDLKRGNFTEEEDELIIKLHSLLGNKWSLIAGRLPGRTDNEIKNYWNTHIRRKLLSRGIDPVTHRPINEHTSNITISFEDWGQGKALKCPDLNLDLCISPPCQEEEEAMLLRPVKREEAGLCFSCSLGLPKSADCKCSNFLGLRTAMLDFRRLEMK

SEQ ID NO: 1005 - DNA, 1372 bp, Zea mays
  G3532
gcacgagctcacagcagcagcagcaacaacaacctccactgccgcaacccaccgagaggcgagaccggcggcggcaaaaggacgatacaaaagcagccagggttgctggcaacagcgtcggtcgcccgcccgctcgccatggggaggtcgccgtgctgcgagaaggcgcacaccaacaagggcgcgtggaccaaggaggaggacgagcgcctggtcgcgcacatcagggcgcacggcgaggggtgctggcgctcgctgcccaaggccgccggcctcctgcgctgcggcaagagctgccgcctccgctggatcaactacctccgccccgacctcaagcgcggcaacttcacggaggaggaggacgagctcatcgtcaagctgcacagcgtcctcggcaacaagtggtccctgatcgccggaaggctgcccggcaggacggacaacgagatcaagaactactggaacacgcacatccggaggaagctgctgagcagggggatcgacccggtgacgcaccgcccggtcacggagcaccacgcgtccaacatcaccatatcgttcgagacggaggtggccgccgctgcccgtgatgataagaagggcgccgtcttccggctggaggaggaggaggagcgcaacaaggcgacgatggtcgtcggccgcgaccggcagagccagagccagagccacagccaccccgccggcgagtggggccaggggaagaggccgctcaagtgccccgacctcaacctggacctctgcatcagcccgccgtgccaggaggaggaggagatggaggaggctgcgatgagagtgagaccggcggtgaagcgggaggccgggctctgcttcggctgcagcctggggctccccaggaccgcggactgcaagtgcagcagcagcagcttcctcgggctcaggaccgccatgctcgacttcagaagcctcgagatgaaatgagcgcgcttctaccctctctgtgtagcttctcccccccgtcgtcctcgtttttgttttgccacacctcacatggatgatgaattgatgatacgtggttggttagttttttcgtaggtgaaaaatacgcgatggtgagcgagtgaaagagagattttgtgccctgggtcctcctccctgctctctcttgctgctccattttgcctccctctgtcctctctctctctctctctctctctctctctctctctctctctgtatctctgtaattaccatcgccaaatgatcatgggggcaaaatctttttgggtctctggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1006 - protein, 273 aa, Zea mays
  G3532 polypeptide
MGRSPCCEKAHTNKGAWTKEEDERLVAHIRAHGEGCWRSLPKAAGLLRCGKSCRLRWINYLRPDLKRGNFTEEEDELIVKLHSVLGNKWSLIAGRLPGRTDNEIKNYWNTHIRRKLLSRGIDPVTHRPVTEHHASNITISFETEVAAAARDDKKGAVFRLEEEEERNKATMVVGRDRQSQSQSHSHPAGEWGQGKRPLKCPDLNLDLCISPPCQEEEEMEEAAMRVRPAVKREAGLCFGCSLGLPRTADCKCSSSSFLGLRTAMLDFRSLEMK

SEQ ID NO: 1007 - DNA, 1420 bp, Zea mays
  G3533
ctaccacccaccaactttagctctgtagaagacctaccctcccgggattcctcagtaaagtgcgtatgcctatctataaaatccagccccgcttcacccacacacctttggccttggcctggcgctcgcacctcacagcagcagcagcaacaacaacctccactgccgcaacccaccgagaggcgagaccggcggcggcaaaaggacgatacaaaagcagccagggttgctggcaacagcgtcggtcgcccgcccgctcgccatggggaggtcgccgtgctgcgagaaggcgcacaccaacaagggcgcgtggaccaaggaggaggacgagcgcctggtcgcgcacatcagggcgcacggcgaggggtgctggcgctcgctgcccaaggccgccggcctcctgcgctgcggcaagagctgccgcctccgctggatcaactacctccgccccgacctcaagcgcggcaacttcacggaggaggaggacgagctcatcgtcaagctgcacagcgtcctcggcaacaagtggtccctgatcgccggaaggctgcccggcaggacggacaacgagatcaagaactactggaacacgcacatccggaggaagctgctgagcagggggatcgacccggtgacgcaccgcccggtcacggagcaccacgcgtccaacatcaccatatcgttcgagacggaggtggccgccgctgcccgtgatgataagaagggcgccgtcttccggctggaggaggaggaggaggagcgcaacaaggcgacgatggtcgtcggccgcgaccggcagagccagagccagagccacagccaccccgccggcgagtggggccaggggaagaggccgctcaagtgccccgacctcaacctggacctctgcatcagcccgccgtgccaggaggaggaggaggagatggaggaggctgcgatgagagtgagaccggcggtgaagcgggaggccgggctctgcttcggctgcagcctggggctccccaggaccgcggactgcaagtgcagcagcagcagcttcctcgggctcaggaccgccatgctcgacttcagaagcctcgagatgaaatgagcgcgcttctaccctctctgtgtagcttctccccccccgtcgtcctcgtttttgttttgccacacctcacatggatgatgaattgatgatacgtggttggttagttttttcgtaggtgaaaaatacgcgatggtgagcgagtgaaagagagattttgtgccctgggtcctcctccctgctctctcttgctgctccattttgcctccctctgtcctctctctctctctctctctctctctctctctctctctctctctctctctgtatctctgtaattaccatcgccaaatgatcatgggggcaatatcatgctaggtctctggaaaaaaa

SEQ ID NO: 1008 - protein, 275 aa, Zea mays
  G3533 polypeptide
MGRSPCCEKAHTNKGAWTKEEDERLVAHIRAHGEGCWRSLPKAAGLLRCGKSCRLRWINYLRPDLKRGNFTEEEDELIVKLHSVLGNKWSLIAGRLPGRTDNEIKNYWNTHIRRKLLSRGIDPVTHRPVTEHHASNITISFETEVAAAARDDKKGAVFRLEEEEEERNKATMVVGRDRQSQSQSHSHPAGEWGQGKRPLKCPDLNLDLCISPPCQEEEEEMEEAAMRVRPAVKREAGLCFGCSLGLPRTADCKCSSSSFLGLRTAMLDFRSLEMK

SEQ ID NO: 1009 - DNA, 963 bp, Zea mays
  G3534
gtagcaacaagcaaaagcccagatcgataatacgatggggcggtcgccgtgctgcgagaaggcgcacaccaacaggggcgcgtggaccaaggaggaggacgagcggctggtggcctacgtccgcgcgcacggcgaagggtgctggcgctcgctgcccagggcggcgggcctgctgcgctgcggcaagagctgccgcctgcgctggatcaactacctccgcccggacctcaagcgcggcaacttcaccgccgacgaggacgacctcatcgtcaagctgcacagcctcctcgggaacaagtggtcgctcatcgccgcgcggctcccggggcggacggacaacgagatcaagaactactggaacacgcacgtccggcggaagctgctgggcaggggcatcgaccccgtcacgcaccgccccatcgccgccgacgccgtgaccgtgaccaccgtctcgttccagcccagccccagcgccgccgccgcagcagcagcagaagccgaggcgacggccgccaaggcgcccagatgccccgacctcaacctcgacctctgcatcagcccgccgtgccagcagcaggaggaggaggaggaggtggacctcaagccctccgccgccgtcgtcaagcgggaggttctgctgggcggccgcggccacggccacggcggggcgctctgcttcggctgcagcctgggcgtccagaagggcgcgcccgggtgcagctgcagcagcagcaacggccaccgctgcttggggctcaggggcggcatgctggactttagaggcctcaagatgaagtgaacgaagcccagcgagatgggcggattcttctggttcgtcggtttggttggttctcgccttgatggatctggatagctagttcctggtaggaggatagtggaagatgagaaggagagccaagatggcgagaggattcgtggctcgtggatagcttagttcctccg

SEQ ID NO: 1010 - protein, 254 aa, Zea mays
  G3534 polypeptide
MGRSPCCEKAHTNRGAWTKEEDERLVAYVRAHGEGCWRSLPRAAGLLRCGKSCRLRWINYLRPDLKRGNFTADEDDLIVKLHSLLGNKWSLIAARLPGRTDNEIKNYWNTHVRRKLLGRGIDPVTHRPIAADAVTVTTVSFQPSPSAAAAAAAEAEATAAKAPRCPDLNLDLCISPPCQQQEEEEEVDLKPSAAVVKREVLLGGRGHGHGGALCFGCSLGVQKGAPGCSCSSSNGHRCLGLRGGMLDFRGLKMK

SEQ ID NO: 1011 - DNA, 1247 bp, Oryza sativa
  G3809
tcttcttcttccatcgattgcattcaaatattgatcaatcacgagattaattgattgatatccatatatatatgatgaccatcgacctgcagcttccggcggcggcgtgcggtgatcatcacacagcagcaggggcagggctgccgccgggattccggttccacccgacggacgaggagctcctcctccactacctcggcaagcgcgccgcggcggcgccctgcccggcaccggtgatcgccgaggtggacatttacaagtacaacccgtgggagctgccggccatggcggtgttcggggagtcggatggcgagtggtacttcttcagcccacgcgaccgcaagtaccccaacggcgtccgtcccaaccgcgccgccggctccggctactggaaggccaccggaaccgacaagcccatctccatctcggagacgcagcagacggtactgctgggcgtgaagaaggccctcgtcttctaccgcggtcgcccgcccaagggcaccaagaccagctggatcatgcacgagtaccgcctcgccaacgccgccgcctcctcctcctcctcctatactagtaacatgaagcagctggcctcatcatcatcgtccagctccagcagcgccagcatgagggtacgtacgtgctacggtgctagtgctaactacatatatatatatcctcttccatatactccatccactgatcgatatatatatatgcgcaattatattcatgcgcgtacgcagctggacgagtgggtgctgtgcagaatctacaagaagaaggaggccaaccagcagctgcagcactacatcgacatgatgatggacgacgacaacgatgacgaacacaacctgcaggtgcagcagcagcagcagcagcaggctcaaagccaccggatgccaaggcctccatccatctcagactaccttctcgactactccgacgacctcccgccgtccaccgatcagacgccatctctgcaccttggattcacggcggtgaacgagggcaacaacaagaggcacaaaactatggaggaatattattctatttccatttccactgcagatatgctgcatgcgtcgtcgtccacgtccaacaacaagtcgacgcaaatcaacttctcctccatatttgagccgcagacgcctgcagctgcgggccatcagctgatgtcttctcacaacgacgacacatccatatgaccaacctcccccatcaactatctaaagctaggttagcag

SEQ ID NO: 1012 - protein, 378 aa, Oryza sativa
  G3809 polypeptide
MMTIDLQLPAAACGDHHTAAGAGLPPGFRFHPTDEELLLHYLGKRAAAAPCPAPVIAEVDIYKYNPWELPAMAVFGESDGEWYFFSPRDRKYPNGVRPNRAAGSGYWKATGTDKPISISETQQTVLLGVKKALVFYRGRPPKGTKTSWIMHEYRLANAAASSSSSYTSNMKQLASSSSSSSSSASMRVRTCYGASANYIYIYPLPYTPSTDRYIYMRNYIHARTQLDEWVLCRIYKKKEANQQLQHYIDMMMDDDNDDEHNLQVQQQQQQQAQSHRMPRPPSISDYLLDYSDDLPPSTDQTPSLHLGFTAVNEGNNKRHKTMEEYYSISISTADMLHASSSTSNNKSTQINFSSIFEPQTPAAAGHQLMSSHNDDTSI

SEQ ID NO: 1013 - DNA, 1420 bp, Artificial Sequence
  P1374 construct encoding full length splice variant of Arabidopsis thaliana G634 polypeptide
ctagagagaaagagagagtgtgtgtgtagaaaaagattgaaacatcatcaagattgatggagcaaggaggaggtggtggtggtaatgaagttgtggaggaagcttcacctattagttcaagacctcctgctaacaacttagaagagcttatgagattctcagccgccgcggatgacggtggattaggaggtggaggtggaggaggaggaggaggaagtgcttcttcttcatcgggaaatcgatggccgagagaagaaactttagctcttcttcggatccgatccgatatggattctacttttcgtgatgctactctcaaagctcctctttgggaacatgtttccaggaagctattggagttaggttacaaacgaagttcaaagaaatgcaaagagaaattcgaaaacgttcagaaatattacaaacgtactaaagaaactcgcggtggtcgtcatgatggtaaagcttacaagttcttctctcagcttgaagctctcaacactactcctccttcatcttccctcgacgttactcctctctccgtcgctaatcccattctcatgccttcttcttcttcttctccatttcccgtattctctcaaccgcaaccgcaaacgcaaacgcaaccgcctcaaacgcataatgtctcttttactcctactccaccgtatcaaccgccacccgcggtcactaaacgtgtggcggaaccaccattatcaacagctcaatctcaatcacaacaaccaataatggcgattccacaacaacaaattcttcctcctcctcctccttctcatcctcacgctcatcaaccagaacagaaacaacaacaacaaccacaacaagagatggtcatgagctcggaacaatcatcattaccatcatcatcaagatggccaaaggcagagattctagcgcttataaacctgagaagtggaatggaaccaaggtaccaagataatgtacctaaaggacttctatgggaagagatctcaacttcaatgaagagaatgggatacaacagaaacgctaagagatgtaaagagaaatgggaaaacataaacaaatactacaagaaagttaaagaaagcaacaagaaacgtcctcaagatgctaagacttgtccttactttcaccgcctcgatcttctttaccgcaacaaagtactcggtagtggcggtggttctagcacttctggtctacctcaagaccaaaaacagagtccggtcactgcgatgaaaccgccacaagaaggacttgttaatgttcaacaaactcatgggtcagcttcaactgaggaagaagagcctatagaggaaagtccacaaggaacagaaaagaagaccttgtgatgagagagctgattcaacaacaacagcaactacaacaacaagaatcaatgataggtgagtatgaaaag

SEQ ID NO: 1014 - protein, 431 aa, Artificial Sequence
  full length splice variant of Arabidopsis thaliana G634 polypeptide encoded by the P1374 construct (SEQ ID NO: 1013)
MEQGGGGGGNEVVEEASPISSRPPANNLEELMRFSAAADDGGLGGGGGGGGGGSASSSSGNRWPREETLALLRIRSDMDSTFRDATLKAPLWEHVSRKLLELGYKRSSKKCKEKFENVQKYYKRTKETRGGRHDGKAYKFFSQLEALNTTPPSSSLDVTPLSVANPILMPSSSSSPFPVFSQPQPQTQTQPPQTHNVSFTPTPPYQPPPAVTKRVAEPPLSTAQSQSQQPIMAIPQQQILPPPPPSHPHAHQPEQKQQQQPQQEMVMSSEQSSLPSSSRWPKAEILALINLRSGMEPRYQDNVPKGLLWEEISTSMKRMGYNRNAKRCKEKWENINKYYKKVKESNKKRPQDAKTCPYFHRLDLLYRNKVLGSGGGSSTSGLPQDQKQSPVTAMKPPQEGLVNVQQTHGSASTEEEEPIEESPQGTEKKTL

SEQ ID NO: 1015 - DNA, 2707 bp, Artificial Sequence
  P324 construct encoding truncated variant of Arabidopsis thaliana G634 polypeptide
ggagctagagagaaagagagagtgtgtgtgtagaaaaagattgaaacatcatcaagattgatggagcaaggaggaggtggtggtggtaatgaagttgtggaggaagcttcacctattagttcaagacctcctgctaacaacttagaagagcttatgagattctcagccgccgcggatgacggtggattaggaggtggaggtggaggaggaggaggaggaagtgcttcttcttcatcgggaaatcgatggccgagagaagaaactttagctcttcttcggatccgatccgatatggattctacttttcgtgatgctactctcaaagctcctctttgggaacatgtttccaggtctctcttcctctcttctcttccattttcatcaatggtgtttcttgatagagatccatttgcatgtgttttttttttgttaactttttttttttagtgttaggtatatataaatagtaatatattcgagatcaaagcatcttcaccatccccaagaaaaattaaaagaactgtttgtttattacagaagttggttcatgagtttctgggacgttttcgattttgaaaatcccaagactctctttacttccaaaaaaaaaaaaaaaaaatccgatcgaacagtaaccataaaaattttccagctaataacgacaaccaaaaataaaataaaactagagaatctgaattattttcatgtttttggaaacaggaagctattggagttaggttacaaacgaagttcaaagaaatgcaaagagaaattcgaaaacgttcagaaatattacaaacgtactaaagaaactcgcggtggtcgtcatgatggtaaagcttacaagttcttctctcagcttgaagctctcaacactactcctccttcatcttccctcgacgttactcctctctccgtcgctaatcccattctcatgccttcttcttcttcttctccatttcccgtattctctcaaccgcaaccgcaaacgcaaacgcaaccgcctcaaacgcataatgtctcttttactcctactccaccacctcttccacttccttcaatgggtccgatatttaccggtgttactttctcgtctcatagctcatcgacggcttcaggaatggggtctgatgatgatgacgacgatatggacgttgatcaggctaacattgcgggttctagtagccgaaaacgcaaacgtggaaaccgcggtggaggcggtaaaatgatggaattgtttgaaggtttggtgagacaagtaatgcaaaagcaagcggctatgcaaaggagtttcttggaagctcttgagaagagagagcaagaacgtcttgatcgtgaagaagcttggaaacgtcaagaaatggctcggttagctcgagaacacgaggtcatgtctcaagaacgagccgcctctgcttctcgtgacgccgcaatcatttcattgattcagaaaattactggccataccattcagttacctccttctttgtcatctcaaccgcctccaccgtatcaaccgccacccgcggtcactaaacgtgtggcggaaccaccattatcaacagctcaatctcaatcacaacaaccaataatggcgattccacaacaacaaattcttcctcctcctcctccttctcatcctcacgctcatcaaccagaacagaaacaacaacaacaaccacaacaagagatggtcatgagctcggaacaatcatcattaccatcatcatcaagatggccaaaggcagagattctagcgcttataaacctgagaagtggaatggaaccaaggtaccaagataatgtacctaaaggacttctatgggaagagatctcaacttcaatgaagagaatgggatacaacagaaacgctaagagatgtaaagagaaatgggaaaacataaacaaatactacaagaaagttaaagaaagcaacaagaaacgtcctcaagatgctaagacttgtccttactttcaccgcctcgatcttctttaccgcaacaaagtactcggtagtggcggtggttctagcacttctggtctacctcaagaccaaaaacagagtccggtcactgcgatgaaaccgccacaagaaggacttgttaatgttcaacaaactcatgggtcagcttcaactgaggaagaagagcctatagaggaaagtccacaaggaacagaaaaggtacaaactttgcttttccttgtcaaaatgtgattggtttaatgttctttgataactgaaatatgatttgttggaattgaagccagaagaccttgtgatgagagagctgattcaacaacaacagcaactacaacaacaagaatcaatgataggtgagtatgaaaagattgaagagtctcacaattataataacatggaggaagaggaagatcaggaaatggatgaggaagaactagacgaggatgagaagtccgcggctttcgagattgcgtttcaaagccctgcaaacagaggaggcaatggccatacggaaccacctttcttgacaatggttcagtaaaatcagaatcattgtttcaagaaaatgtacttatgtgtgcatagttttctaaacaaaacacccaaaaacacaaaacacaaacacacacacacacacatctgacaccacaaactgaaatatcaaggtctcatcgatcttcgatttttcagtgaatacaattctttttcacattctttcccttttgt

SEQ ID NO: 1016 - protein, 128 aa, Artificial Sequence
  truncated variant of Arabidopsis thaliana G634 polypeptide encoded by the P324 construct (SEQ ID NO: 1015)
MEQGGGGGGNEVVEEASPISSRPPANNLEELMRFSAAADDGGLGGGGGGGGGGSASSSSGNRWPREETLALLRIRSDMDSTFRDATLKAPLWEHVSRSLFLSSLPFSSMVFLDRDPFACVFFLLTFFF

SEQ ID NO: 1017 - DNA, 1652 bp, Artificial Sequence
  P1717 construct encoding full length splice variant of Arabidopsis thaliana G634 polypeptide
cgtcgacctagagagaaagagagagtgtgtgtgtagaaaaagattgaaacatcatcaagattgatggagcaaggaggaggtggtggtggtaatgaagttgtggaggaagcttcacctattagttcaagacctcctgctaacaacttagaagagcttatgagattctcagccgccgcggatgacggtggattaggaggtggaggtggaggaggaggaggaggaagtgcttcttcttcatcgggaaatcgatggccgagagaagaaactttagctcttcttcggatccgatccgatatggattctacttttcgtgatgctactctcaaagctcctctttgggaacatgtttccaggaagctattggagttaggttacaaacgaagttcaaagaaatgcaaagagaaattcgaaaacgttcagaaatattacaaacgtactaaagaaactcgcggtggtcgtcatgatggtaaagcttacaagttcttctctcagcttgaagctctcaacactactcctccttcatcttccctcgacgttactcctctctccgtcgctaatcccattctcatgccttcttcttcttcttctccatttcccgtattctctcaaccgcaaccgcaaacgcaaacgcaaccgcctcaaacgcataatgtctcttttactcctactccaccgtatcaaccgccacccgcggtcactaaacgtgtggcggaaccaccattatcaacagctcaatctcaatcacaacaaccaataatggcgattccacaacaacaaattcttcctcctcctcctccttctcatcctcacgctcatcaaccagaacagaaacaacaacaacaaccacaacaagagatggtcatgagctcggaacaatcatcattaccatcatcatcaagatggccaaaggcagagattctagcgcttataaacctgagaagtggaatggaaccaaggtaccaagataatgtacctaaaggacttctatgggaagagatctcaacttcaatgaagagaatgggatacaacagaaacgctaagagatgtaaagagaaatgggaaaacataaacaaatactacaagaaagttaaagaaagcaacaagaaacgtcctcaagatgctaagacttgtccttactttcaccgcctcgatcttctttaccgcaacaaagtactcggtagtggcggtggttctagcacttctggtctacctcaagaccaaaaacagagtccggtcactgcgatgaaaccgccacaagaaggacttgttaatgttcaacaaactcatgggtcagcttcaactgaggaagaagagcctatagaggaaagtccacaaggaacagaaaagaagaccttgtgatgagagagctgattcaacaacaacagcaactacaacaacaagaatcaatgataggtgagtatgaaaagattgaagagtctcacaattataataacatggaggaagaggaagatcaggaaatggatgaggaagaactagacgaggatgagaagtccgcggctttcgagattgcgtttcaaagccctgcaaacagaggaggcaatggccatacggaaccacctttcttgacaatggttcagtaaaatcagaatcattgtttcaagaaaatgtacttatgtgtgcatagttttcgc

SEQ ID NO: 1018 - protein, 346 aa, Artificial Sequence
  full length splice variant of Arabidopsis thaliana G634 polypeptide encoded by the P1717 construct (SEQ ID NO: 1017)
MEQGGGGGGNEVVEEASPISSRPPANNLEELMRFSAAADDGGLGGGGGGGGGGSASSSSGNRWPREETLALLRIRSDMDSTFRDATLKAPLWEHVSRKLLELGYKRSSKKCKEKFENVQKYYKRTKETRGGRHDGKAYKFFSQLEALNTTPPSSSLDVTPLSVANPILMPSSSSSPFPVFSQPQPQTQTQPPQTHNVSFTPTPPYQPPPAVTKRVAEPPLSTAQSQSQQPIMAIPQQQILPPPPPSHPHAHQPEQKQQQQPQQEMVMSSEQSSLPSSSRWPKAEILALINLRSGMEPRYQDNVPKGLLWEEISTSMKRMGYNRNAKRCKEKWENINKYYKKVKESN

SEQ ID NO: 1019 - protein, 50 aa, Arabidopsis thaliana
DQSKYKGIRRRKWGKWVSEIRVPGTRQRLWLGSFSTAEGAAVAHDVAFYC

SEQ ID NO: 1020 - protein, 50 aa, Brassica oleracea
HQAKYKGIRRRKWGKWVSEIRVPATRERLWLGSFSTAEGAAVAHDVAFYC

SEQ ID NO: 1021 - protein, 50 aa, Brassica rapa
TQSKYKGIRRRKWGKWVSEIRVPGTRDRLWLGSFSTAEGAAVAHDVAFYC

SEQ ID NO: 1022 - protein, 50 aa, Arabidopsis thaliana
SQSKYKGIRRRKWGKWVSEIRVPGTRDRLWLGSFSTAEGAAVAHDVAFFC

SEQ ID NO: 1023 - protein, 50 aa, Glycine max
TNNKLKGVRRRKWGKWVSEIRVPGTQERLWLGTYATPEAAAVAHDVAVYC

SEQ ID NO: 1024 - protein, 50 aa, Zinnia elegans
SQKTYKGVRCRRWGKWVSEIRVPGSRERLWLGTYSTPEGAAVAHDVASYC

SEQ ID NO: 1025 - protein, 50 aa, Medicago truncatula
SNKKFKGVRRRKWGKWVSEIRVPGTQERLWLGTYATPEAAAVAHDVAFYC

SEQ ID NO: 1026 - protein, 50 aa, Oryza sativa
ERCRYRGVRRRRWGKWVSEIRVPGTRERLWLGSYATPEAAAVAHDTAVYF

SEQ ID NO: 1027 - protein, 50 aa, Oryza sativa
EMMRYRGVRRRRWGKWVSEIRVPGTRERLWLGSYATAEAAAVAHDAAVCL

SEQ ID NO: 1028 - protein, 50 aa, Zea mays
RRCRYRGVRRRAWGKWVSEIRVPGTRERLWLGSYAAPEAAAVAHDAAACL

SEQ ID NO: 1029 - protein, 50 aa, Oryza sativa; identical to SEQ ID NO: 1026

SEQ ID NO: 1030 - protein, 50 aa, Oryza sativa
TTTKYRGVRLRKWGKWVSEIRLPNSRERIWLGSYDTPEEAARAFDAAFVC

SEQ ID NO: 1031 - protein, 50 aa, Oryza sativa
KETRYKGVRLRQWGKWVAEIRLPNSRKRIWLGSYYTPEKAARAFDAAFIC

SEQ ID NO: 1032 - protein, 50 aa, Oryza sativa
VERKYRGVRLRQWGKWVAEIRLPNSLKRIWLGSYDSPEKAARAFDAAFIC

SEQ ID NO: 1033 - protein, 50 aa, Oryza sativa
ERRKYKGVRLRQWGKWAAEIRLPSSCERIWLGSYDTPEKAARAFDAAFIC

SEQ ID NO: 1034 - protein, 50 aa, Arabidopsis thaliana
MQSKYKGVRKRKWGKWVSEIRLPNSRERIWLGSYDTPEKAARAFDAALYC

SEQ ID NO: 1035 - protein, 50 aa, Arabidopsis thaliana
MQSKYKGVRKRKWGKWVSEIRLPHSRERIWLGSYDTPEKAARAFDAAQFC

SEQ ID NO: 1036 - protein, 50 aa, Arabidopsis thaliana
RERPFKGIRMRKWGKWVAEIREPNKRSRLWLGSYSTPEAAARAYDTAVFY

SEQ ID NO: 1037 - protein, 50 aa, Arabidopsis thaliana
RDKPYKGIRMRKWGKWVAEIREPNKRSRIWLGSYSTPEAAARAYDTAVFY

SEQ ID NO: 1038 - protein, 50 aa, Arabidopsis thaliana
DLKPYKGIRMRKWGKWVAEIREPNKRSRIWLGSYATPEAAARAYDTAVFY

SEQ ID NO: 1039 - protein, 48 aa, Arabidopsis thaliana
PSSKYKGVVPQPNGRWGAQIYEKHQRVWLGTFNEEDEAARAYDVAVHR

SEQ ID NO: 1040 - protein, 50 aa, Arabidopsis thaliana
RHPIYRGVRQRNSGKWVSEVREPNKKTRIWLGTFQTAEMAARAHDVAALA

SEQ ID NO: 1041 - protein, 50 aa, Arabidopsis thaliana
RMKKYKGVRMRSWGSWVSEIRAPNQKTRIWLGSYSTAEAAARAYDAALLC

SEQ ID NO: 1042 - protein, 50 aa, Arabidopsis thaliana
KIKKYKGVRMRSWGSWVSEIRAPNQKTRIWLGSYSTAEAAARAYDVALLC

SEQ ID NO: 1043 - protein, 61 aa, Arabidopsis thaliana
RKKGKLPKEARQQLLDWWSRHYKWPYPSEQQKLALAESTGLDQKQINNWFINQRKRHWKPS

SEQ ID NO: 1044 - protein, 61 aa, Arabidopsis thaliana
KKKGKLPKEARQKLLTWWELHYKWPYPSESEKVALAESTGLDQKQINNWFINQRKRHWKPS

SEQ ID NO: 1045 - protein, 61 aa, Arabidopsis thaliana
RRAGKLPGDTTSVLKEWWRTHSKWPYPTEEDKAKLVQETGLQLKQINNWFINQRKRNWNSN

SEQ ID NO: 1046 - protein, 61 aa, Arabidopsis thaliana
RRAGKLPGDTTSVLKAWWQSHSKWPYPTEEDKARLVQETGLQLKQINNWFINQRKRNWHSN

SEQ ID NO: 1047 - protein, 61 aa, Arabidopsis thaliana
RPQRGLPERSVNILRAWLFEHFLHPYPSDADKHLLARQTGLSRNQVSNWFINARVRLWKPM

SEQ ID NO: 1048 - protein, 61 aa, Arabidopsis thaliana
RPQRGLPERAVTTLRAWLFEHFLHPYPSDVDKHILARQTGLSRSQVSNWFINARVRLWKPM

SEQ ID NO: 1049 - protein, 61 aa, Arabidopsis thaliana
NGLFRKRKLTDEQVNMLEMSFGDEHKLESERKDRLAAELGLDPRQVAVWFQNRRARWKNKR

SEQ ID NO: 1050 - protein, 61 aa, Arabidopsis thaliana
NGWFRKRKLSDEQVRMLEISFEDDHKLESERKDRLASELGLDPRQVAVWFQNRRARWKNKR

SEQ ID NO: 1051 - protein, 61 aa, Arabidopsis thaliana
ETSRKKLRLSKDQSAFLEETFKEHNTLNPKQKLALAKKLNLTARQVEVWFQNRRARTKLKQ

SEQ ID NO: 1052 - protein, 61 aa, Arabidopsis thaliana
DNSRKKLRLSKDQSAILEETFKDHSTLNPKQKQALAKQLGLRARQVEVWFQNRRARTKLKQ

SEQ ID NO: 1053 - protein, 61 aa, Arabidopsis thaliana
NKKKRYHRHTQRQIQELESFFKECPHPDDKQRKELSRELSLEPLQVKFWFQNKRTQMKAQH

SEQ ID NO: 1054 - protein, 61 aa, Arabidopsis thaliana
RKRKKYHRHTTDQIRHMEALFKETPHPDEKQRQQLSKQLGLAPRQVKFWFQNRRTQIKAIQ

SEQ ID NO: 1055 - protein, 61 aa, Arabidopsis thaliana
KYVRYTPEQVEALERLYNDCPKPSSMRRQQLIRECPILSNIEPKQIKVWFQNRRCREKQRK

SEQ ID NO: 1056 - protein, 61 aa, Arabidopsis thaliana
KYVRYTAEQVEALERVYAECPKPSSLRRQQLIRECSILANIEPKQIKVWFQNRRCRDKQRK

SEQ ID NO: 1057 - protein, 61 aa, Arabidopsis thaliana
RWNPKPEQIRILESIFNSGTINPPREEIQRIRIRLQEYGQIGDANVFYWFQNRKSRAKHKL

SEQ ID NO: 1058 - protein, 61 aa, Arabidopsis thaliana
WTPTTEQIKILKELYYNNAIRSPTADQIQKITARLRQFGKIEGKNVFYWFQNHKARERQKK

SEQ ID NO: 1059 - protein, 61 aa, Arabidopsis thaliana
KSSSSACKQTDPKTQRLYISFQENQYPDKATKESLAKELQMTVKQVNNWFKHRRWSINSKP

SEQ ID NO: 1060 - protein, 60 aa, Arabidopsis thaliana
GGRRRMFRLPRNAVELRQVFAETELPSKAVRDRLAKELSLDPEKVNKWFKNTRYMALRNR

SEQ ID NO: 1061 - protein, 64 aa, Arabidopsis thaliana
VQRRRKSKFTAEQREAMKDYAAKLGWTLKDKRALREEIRVFCEGIGVTRYHFKTWVNNNKKFYH

SEQ ID NO: 1062 - protein, 64 aa, Arabidopsis thaliana
VKRLKTKFTAEQTEKMRDYAEKLRWKVRPERQEEVEEFCVEIGVNRKNFRIWMNNHKDKIIIDE

SEQ ID NO: 1063 - protein, 64 aa, Arabidopsis thaliana
KKRVRTKINEEQKEKMKEFAERLGWRMQKKDEEEIDKFCRMVNLRRQVFKVWMHNNKQAMKRNN

SEQ ID NO: 1064 - protein, 64 aa, Arabidopsis thaliana
KKRFRTKFNEEQKEKMMEFAEKIGWRMTKLEDDEVNRFCREIKVKRQVFKVWMHNNKQAAKKKD

SEQ ID NO: 1065 - protein, 64 aa, Arabidopsis thaliana
KKRFRTKFTTDQKERMMDFAEKLGWRMNKQDEEELKRFCGEIGVKRQVFKVWMHNNKNNAKKPP

SEQ ID NO: 1066 - protein, 64 aa, Arabidopsis thaliana
TKRFRTKFTAEQKEKMLAFAERLGWRIQKHDDVAVEQFCAETGVRRQVLKIWMHNNKNSLGKKP

SEQ ID NO: 1067 - protein, 66 aa, Arabidopsis thaliana
RKRHRTKFTAEQKERMLALAERIGWRIQRQDDEVIQRFCQETGVPRQVLKVWLHNNKHTLGKSPSP

SEQ ID NO: 1068 - protein, 64 aa, Arabidopsis thaliana
KKHKRTKFTAEQKVKMRGFAERAGWKINGWDEKWVREFCSEVGIERKVLKVWIHNNKYFNNGRS

SEQ ID NO: 1069 - protein, 64 aa, Arabidopsis thaliana
KRFRTKFTPEQKEKMLSFAEKVGWKIQRQEDCVVQRFCEEIGVKRRVLKVWMHNNKIHFSKKNN

SEQ ID NO: 1070 - protein, 64 aa, Arabidopsis thaliana
KKRFRTKFTQEQKEKMISFAERVGWKIQRQEESVVQQLCQEIGIRRRVLKVWMHNNKQNLSKKS

SEQ ID NO: 1071 - protein, 64 aa, Arabidopsis thaliana
RKRTRTKFTPEQKIKMRAFAEKAGWKINGCDEKSVREFCNEVGIERGVLKVWMHNNKYSLLNGK

SEQ ID NO: 1072 - protein, 64 aa, Arabidopsis thaliana
RKRFRTKFSQYQKEKMFEFSERVGWRMPKADDVVVKEFCREIGVDKSVFKVWMHNNKISGRSGA

SEQ ID NO: 1073 - protein, 64 aa, Arabidopsis thaliana
RKRFRTKFSQFQKEKMHEFAERVGWKMQKRDEDDVRDFCRQIGVDKSVLKVWMHNNKNTFNRRD

SEQ ID NO: 1074 - protein, 64 aa, Arabidopsis thaliana
RKRFRTKFSSNQKEKMHEFADRIGWKIQKRDEDEVRDFCREIGVDKGVLKVWMHNNKNSFKFSG

SEQ ID NO: 1075 - protein, 16 aa, Arabidopsis thaliana
LVVFEDLGAEYLEQLL

SEQ ID NO: 1076 - protein, 16 aa, Arabidopsis thaliana
VIEFEYLDDSLLEELL

SEQ ID NO: 1077 - protein, 16 aa, Arabidopsis thaliana
VFEFEYLDDSVLEELL

SEQ ID NO: 1078 - protein, 16 aa, Arabidopsis thaliana
VFEFEYLDDSVLDELL

SEQ ID NO: 1079 - protein, 16 aa, Oryza sativa
VIELECLDDQVLQEML

SEQ ID NO: 1080 - protein, 16 aa, Zea mays
VIELECLDDQVLQEML

SEQ ID NO: 1081 - protein, 16 aa, Triticum aestivum
VIEFEYLDDDVLQSML

SEQ ID NO: 1082 - protein, 16 aa, Oryza sativa
PIEFEYLDDHVLQEML

SEQ ID NO: 1083 - protein, 16 aa, Zea mays
VIEFEYLDDEVLQEML

SEQ ID NO: 1084 - protein, 16 aa, Zea mays
VIELEYLDDEVLQEML

SEQ ID NO: 1085 - protein, 16 aa, Glycine max
VIEFECLDDKLLEDLL

SEQ ID NO: 1086 - protein, 16 aa, Oryza sativa
KIEFEYLDDKVLDDLL

SEQ ID NO: 1087 - protein, 16 aa, Oryza sativa
KVELVYLDDKVLDELL

SEQ ID NO: 1088 - protein, 16 aa, Oryza sativa
KVELECLDDKVLEDLL

SEQ ID NO: 1089 - protein, 16 aa, Zea mays
KVELECLDDRVLEELL

SEQ ID NO: 1090 - protein, 16 aa, Arabidopsis thaliana
VFEFEYLDDKVLEELL

SEQ ID NO: 1091 - protein, 16 aa, Glycine max
TFELEYFDNKLLEELL

SEQ ID NO: 1092 - protein, 16 aa, Glycine max
TFELEYLDNKLLEELL

SEQ ID NO: 1093 - protein, 14 aa, Medicago truncatula
ELEFLDNKLLQELL

SEQ ID NO: 1094 - protein, 16 aa, Arabidopsis thaliana
SSSSSSLNHQGLRPNL

SEQ ID NO: 1095 - protein, 16 aa, Arabidopsis thaliana
ELDFTVDQFYFDGSLL

SEQ ID NO: 1096 - protein, 14 aa, Arabidopsis thaliana
KCEVGDETRVDELL

SEQ ID NO: 1097 - protein, 16 aa, Arabidopsis thaliana
TVKCEVVEVARGDRLL

SEQ ID NO: 1098 - protein, 16 aa, Arabidopsis thaliana
CNMEEWMNMMMMMDFG

SEQ ID NO: 1099 - protein, 16 aa, Arabidopsis thaliana
LFEFEDLGSDYLETLL

SEQ ID NO: 1100 - protein, 16 aa, Arabidopsis thaliana
VVVFEDLGEQYLEELL

SEQ ID NO: 1101 - protein, 15 aa, Arabidopsis thaliana
LVVLEDLGAEYLEEL

SEQ ID NO: 1102 - protein, 14 aa, Arabidopsis thaliana
  misc_feature (2)..(2): Xaa can be F or L
  misc_feature (3)..(3): Xaa can be E or V
  misc_feature (4)..(4): Xaa can be Y, C, or F
  misc_feature (5)..(5): Xaa can be L or F
  misc_feature (7)..(7): Xaa can be D or N
  misc_feature (8)..(8): Xaa can be S, Q, D, H, E, K, or R
  misc_feature (9)..(9): Xaa can be L or V
  misc_feature (11)..(11): Xaa can be E, D, or Q
  misc_feature (12)..(12): Xaa can be E, D, or S
  misc_feature (13)..(13): Xaa can be L or M
EXXXXDXXXLXXXL

SEQ ID NO: 1103 - protein, 218 aa, Arabidopsis thaliana
MHSGKRPLSPESMAGNREEKKELCCCSTLSESDVSDFVSELTGQPIPSSIDDQSSSLTLQEKSNSRQRNYRGVRQRPWGKWAAEIRDPNKAARVWLGTFDTAEEAALAYDKAAFEFRGHKAKLNFPEHIRVNPTQLYPSPATSHDRIIVTPPSPPPPIAPDILLDQYGHFQSRSSDSSANLSMNMLSSSSSSLNHQGLRPNLEDGENVKNISIHKRRK

SEQ ID NO: 1104 - protein, 226 aa, Arabidopsis thaliana
MSSSDSVNNGVNSRMYFRNPSFSNVILNDNWSDLPLSVDDSQDMAIYNTLRDAVSSGWTPSVPPVTSPAEENKPPATKASGSHAPRQKGMQYRGVRRRPWGKFAAEIRDPKKNGARVWLGTYETPEDAAVAYDRAAFQLRGSKAKLNFPHLIGSCKYEPVRIRPRRRSPEPSVSDQLTSEQKRESHVDDGESSLVVPELDFTVDQFYFDGSLLMDQSECSYSDNRI

SEQ ID NO: 1105 - protein, 243 aa, Arabidopsis thaliana
MYGQCNIESDYALLESITRHLLGGGGENELRLNESTPSSCFTESWGGLPLKENDSEDMLVYGLLKDAFHFDTSSSDLSCLFDFPAVKVEPTENFTAMEEKPKKAIPVTETAVKAKHYRGVRQRPWGKFAAEIRDPAKNGARVWLGTFETAEDAALAYDIAAFRMRGSRALLNFPLRVNSGEPDPVRITSKRSSSSSSSSSSSTSSSENGKLKRRRKAENLTSEVVQVKCEVGDETRVDELLVS

SEQ ID NO: 1106 - protein, 268 aa, Arabidopsis thaliana
MSMTADSQSDYAFLESIRRHLLGESEPILSESTASSVTQSCVTGQSIKPVYGRNPSFSKLYPCFTESWGDLPLKENDSEDMLVYGILNDAFHGGWEPSSSSSDEDRSSFPSVKIETPESFAAVDSVPVKKEKTSPVSAAVTAAKGKHYRGVRQRPWGKFAAEIRDPAKNGARVWLGTFETAEDAALAYDRAAFRMRGSRALLNFPLRVNSGEPDPVRIKSKRSSFSSSNENGAPKKRRTVAAGGGMDKGLTVKCEVVEVARGDRLLVL

SEQ ID NO: 1107 - protein, 268 aa, Arabidopsis thaliana
MHYPNNRTEFVGAPAPTRYQKEQLSPEQELSVIVSALQHVISGENETAPCQGFSSDSTVISAGMPRLDSDTCQVCRIEGCLGCNYFFAPNQRIEKNHQQEEEITSSSNRRRESSPVAKKAEGGGKIRKRKNKKNGYRGVRQRPWGKFAAEIRDPKRATRVWLGTFETAEDAARAYDRAAIGFRGPRAKLNFPFVDYTSSVSSPVAADDIGAKASASASVSATDSVEAEQWNGGGGDCNMEEWMNMMMMMDFGNGDSSDSGNTIADMFQ

SEQ ID NO: 1108 - protein, 349 aa, Arabidopsis thaliana
MVRVCVYTQKTPDFMWNLKPSMKCGQYLRTQVSPTVLPNYPAADSTMAFGNIQELDGEILKNVWANYIGTPQTDTRSIQVPEVSRTWEALPTLDDIPEGSREMLQSLDMSTEDQEWTEILDAIASFPNKTNHDPLTNPTIDSCSLSSRVSCKTRKYRGVRKRPWGKFAAEIRDSTRNGVRVWLGTFQTAEEAAMAYDKAAVRIRGTQKAHTNFQLETVIKAMEMDCNPNYYRMNNSNTSDPLRSSRKIGLRTGKEAVKAYDEVVDGMVENHCALSYCSTKEHSETRGLRGSEETWFDLRKRRRSNEDSMCQEVEMQKTVTGEETVCDVFGLFEFEDLGSDYLETLLSSF

SEQ ID NO: 1109 - protein, 59 aa, Arabidopsis thaliana
  misc_feature (20)..(20): Xaa can be any naturally occurring amino acid
  misc_feature (22)..(22): Xaa can be any naturally occurring amino acid
  misc_feature (24)..(24): Xaa can be any naturally occurring amino acid
  misc_feature (47)..(47): Xaa can be any naturally occurring amino acid
  misc_feature (51)..(53): Xaa can be any naturally occurring amino acid
  misc_feature (55)..(55): Xaa can be any naturally occurring amino acid
YRGVRRRPWGFKAAEIRDPXRXGXRVWLGTFDTAEEAARAYDRAAFXMRGXXXAXLNFP

SEQ ID NO: 1110 - protein, 58 aa, Oryza sativa
RRGQATDPHSIAERLRREKISERMKNLQVLVPNSNKADKASMLDEIIDYVKFLQLQVK

SEQ ID NO: 1111 - protein, 59 aa, Zea mays
RRGQATDPHSIAERLRREKISDRMKNLQDLVPNSNKADKASMLDEIIDYVKFLQLQVKV

SEQ ID NO: 1112 - protein, 59 aa, Oryza sativa
RRGQATDPHSIAERLRREKISDRMKDLQELVPNSNKTNKASMLDEIIDYVKFLQLQVKV

SEQ ID NO: 1113 - protein, 59 aa, Arabidopsis thaliana
RRGQATDPHSIAERLRRERIAERIRSLQELVPTVNKTDRAAMIDEIVDYVKFLRLQVKV

SEQ ID NO: 1114 - protein, 59 aa, Arabidopsis thaliana
RRGQATDPHSIAERLRRERIAERIRALQELVPTVNKTDRAAMIDEIVDYVKFLRLQVKV

SEQ ID NO: 1115 - protein, 60 aa, Oryza sativa
ARRGQATDPHSIAERLRRERIAERMRALQELVPNTNKTDRAAMLDEILDYVKFLRLQVKV

SEQ ID NO: 1116 - protein, 60 aa, Zea mays
ARRGQATDPHSIAERLRRERIAERMKALQELVPNANKTDKASMLDEIVDYVKFLQLQVKV

SEQ ID NO: 1117 - protein, 60 aa, Glycine max
ARRGQATDPHSIAERLRRERIAERMKALQELVPNANKTDKASMLDEIIDYVKFLQLQVKV

SEQ ID NO: 1118 - protein, 59 aa, Arabidopsis thaliana
KRGCATHPRSIAERVRRTRISDRIRKLQELVPNMDKQTNTADMLEEAVEYVKVLQRQIQ

SEQ ID NO: 1119 - protein, 59 aa, Arabidopsis thaliana
KRGCATHPRSIAERVRRTRISDRIRRLQELVPNMDKQTNTADMLEEAVEYVKALQSQIQ

SEQ ID NO: 1120 - protein, 59 aa, Glycine max
KRGCATHPRSIAERVRRTRISDRIRKLQELVPNMDKQTNTADMLDEAVAYVKFLQKQIE

SEQ ID NO: 1121 - protein, 60 aa, Pinus taeda
KRGCATHPRSIAERVRRTRISERMRKLQELVPNSDKQTVNIADMLDEAVEYVKSLQKQVQ

SEQ ID NO: 1122 - protein, 59 aa, Glycine max
KRGCATHPRSIAERVRRTKISERMRKLQDLVPNMDKQTNTADMLDLAVDYIKDLQKQVQ

SEQ ID NO: 1123 - protein, 59 aa, Glycine max; identical to SEQ ID NO: 1122

SEQ ID NO: 1124 - protein, 59 aa, Glycine max
KRGCATHPRSIAERVRRTKISERMRKLQDLVPNMDKQTNTADMLDLAVEYIKDLQNQVQ

SEQ ID NO: 1125 - protein, 59 aa, Arabidopsis thaliana
KRGCATHPRSIAERVRRTKISERMRKLQDLVPNMDTQTNTADMLDLAVQYIKDLQEQVK

SEQ ID NO: 1126 - protein, 59 aa, Oryza sativa
KRGCATHPRSIAERVRRTRISERIRKLQELVPNMDKQTNTADMLDLAVDYIKDLQKQVK

SEQ ID NO: 1127 - protein, 59 aa, Oryza sativa
KRGCATHPRSIAERVRRTRISERIRKLQELVPNMEKQTNTADMLDLAVDYIKELQKQVK

SEQ ID NO: 1128 - protein, 59 aa, Zea mays
KRGCATHPRSIAERVRRTKISERIRKLQELVPNMDKQTNTSDMLDLAVDYIKDLQKQVK

SEQ ID NO: 1129 - protein, 59 aa, Arabidopsis thaliana
KRGCATHPRSIAERVRRTRISERMRKLQELVPNMDKQTNTSDMLDLAVDYIKDLQRQYK

SEQ ID NO: 1130 - protein, 59 aa, Glycine max
KRGCATHPRSIAERVRRTRISERMRKLQELVPHMDKQTNTADMLDLAVEYIKDLQKQFK

SEQ ID NO: 1131 - protein, 59 aa, Glycine max
KRGFATHPRSIAERVRRTRISERIRKLQELVPTMDKQTSTAEMLDLALDYIKDLQKQFK

SEQ ID NO: 1132 - protein, 59 aa, Oryza sativa
KRGCATHPRSIAERERRTRISEKLRKLQELVPNMDKQTSTADMLDLAVEHIKGLQSQLQ

SEQ ID NO: 1133 - protein, 59 aa, Oryza sativa
KRGCATHPRSIAERERRTRISEKLRKLQALVPNMDKQTSTSDMLDLAVDHIKGLQSQLQ

SEQ ID NO: 1134 - protein, 59 aa, Glycine max
KRGCATHPRSIAERERRTRISGKLKKLQDLVPNMDKQTSYADMLDLAVQHIKGLQTQVQ

SEQ ID NO: 1135 - protein, 59 aa, Arabidopsis thaliana
KRGCATHPRSIAERERRTRISGKLKKLQDLVPNMDKQTSYSDMLDLAVQHIKGLQHQLQ

SEQ ID NO: 1136 - protein, 59 aa, Arabidopsis thaliana
KRGFATHPRSIAERERRTRISGKLKKLQELVPNMDKQTSYADMLDLAVEHIKGLQHQVE

SEQ ID NO: 1137 - protein, 59 aa, Oryza sativa
KRGCATHPRSIAERERRTRISKRLKKLQDLVPNMDKQTNTSDMLDIAVTYIKELQGQVE

SEQ ID NO: 1138 - protein, 59 aa, Glycine max
KRGFATHPRSIAERERRTRISARIKKLQDLFPKSDKQTSTADMLDLAVEYIKDLQKQVK

SEQ ID NO: 1139 - protein, 59 aa, Glycine max
KRGFATHPRSIAERVRRTRISERIKKLQDLFPKSEKQTSTADMLDLAVEYIKDLQQKVK

SEQ ID NO: 1140 - protein, 59 aa, Arabidopsis thaliana
SKKPTLSSQSIAARGRRRRIAEKTHELGKLIPGGNKLNTAEMFQAAAKYVKFLQSQVGI

SEQ ID NO: 1141 - protein, 439 aa, Glycine max
MDGLGSPSQWLRELRWDSQGLNPISLLIDCAKCVASGSIKNADIGLEYISQISSPDGNAVQRMVTYFSEALGYRIIKNLPGVYKSLNPSKTSLSSEDILVQKYFYELCPFLKFSYLITNHAIAEAMECEKVVHIIDLHCCEPTQWIDLLLTFKNRQGGPPHLKITGIHEKKEVLDQMNFHLTTEAGKLDFPLQFYPVVSKLEDVDFEKLPVKIGDALAISSVLQLHSLLATDDDMAGRISPAAAASMNVQRALHMGQRTFAEWLERDMINAYTLSPDSALSPLSLGASPKMGIFLNAIRKLQPKLVVITEQESNLNGSNLMERVDRALYFYSALFDCLDSTVMKTSVERQKLESKLLGEQIKNIIACEGVDRKERHEKLEKWIRRLEMAGFEKVPLSYNGRLEAKNLLQRYSNKYKFREENDCLLVCWSDRPLFSRAEF

SEQ ID NO: 1142 - protein, 653 aa, Arabidopsis thaliana
MAESGDFNGGQPPPHSPLRTTSSGSSSSNNRGPPPPPPPPLVMVRKRLASEMSSNPDYNNSSRPPRRVSHLLDSNYNTVTPQQPPSLTAAATVSSQPNPPLSVCGFSGLPVFPSDRGGRNVMMSVQPMDQDSSSSSASPTVWVDAIIRDLIHSSTSVSIPQLIQNVRDIIFPCNPNLGALLEYRLRSLMLLDPSSSSDPSPQTFEPLYQISNNPSPPQQQQQHQQQQQQHKPPPPPIQQQERENSSTDAPPQPETVTATVPAVQTNTAEALRERKEEIKRQKQDEEGLHLLTLLLQCAEAVSADNLEEANKLLLEISQLSTPYGTSAQRVAAYFSEAMSARLLNSCLGIYAALPSRWMPQTHSLKMVSAFQVFNGISPLVKFSHFTANQAIQEAFEKEDSVHIIDLDIMQGLQWPGLFHILASRPGGPPHVRLTGLGTSMEALQATGKRLSDFTDKLGLPFEFCPLAEKVGNLDTERLNVRKREAVAVHWLQHSLYDVTGSDAHTLWLLQRLAPKVVTVVEQDLSHAGSFLGRFVEAIHYYSALFDSLGASYGEESEERHVVEQQLLSKEIRNVLAVGGPSRSGEVKFESWREKMQQCGFKGISLAGNAATQATLLLGMFPSDGYTLVDDNGTLKLGWKDLSLLTASAWTPRS

SEQ ID NO: 1143 - protein, 819 aa, Pisum sativum
MAACALFNGVGGGNTTPDETNNNSTSNSSNISTEDFHNMPQQQPHHSERKLLRKRMASEMELQLHNNNNNNDYHRFSRRTNNTSSLNCSLPATTQKGVTTTTTTTLASSGNNNNNNNNNNNYHYHNNNNNSIINNNNNNVALSRDNVAIQNFPTVTVTTNYSTMLLPSSCSSNLNNSSTSAANYTHYQQPLVEEQNTLPEICGFSGLPLFPSQNNQTNRTNNNSSNNRNNTNTVVDVVSSSPSMEETSATTNWIDGILKDLIHTSNSVSIPQLINNVREIIYPCNPNLALVLEHRLRLLTEPNTCVPERKRNSTEQSGVNVNGNVLAASNVNNSSVKLMNRVDDVVPTSLHFSDSSTLLNQNQNQNMFPNWGATQINNNNNPSVSLVTLPSQPLSTQQDQQHQLQQHPEDLAPATTTTTTSAELALARKKKEEIKEQKKKDEEGLHLLTLLLQCAEAVSAENLEQANKMLLEISQLSTPFGTSAQRVAAYFSEAISARLVSSCLGIYATLPVSSHTPHNQKVASAFQVFNGISPFVKFSHFTANQAIQEAFEREERVHIIDLDIMQGLQWPGLFHILASRPGGPPYVRLTGLGTSMETLEATGKRLSDFANKLGLPFEFFPVAEKVGNIDVEKLNVSKSEAVAVHWLQHSLYDVTGSDTNTLWLLQRLAPKVVTVVEQDLSNAGSFLGRFVEAIHYYSALFDSLGSSYGEESEERHVVEQQLLSREIRNVLAVGGPSRSGEIKFHNWREKLQQCGFRGVSLAGNAATQASLLLGMFPSEGYTLVEDNGILKLGWKDLCLLTASAWRPPYHTNTIIPHHN

SEQ ID NO: 1144 - protein, 668 aa, Zea mays
MPPPPPPPPLTPYCRRCPPPHLPPPPPSSPNHFLLHYLHQLDHQEAAAAAMVRKRPASDMDLPPPRRHVTGDLSDVTAAAAAGVGGSGAPSSASAQLPALPTQLHQLPPAFQHHAPEVDVPAHPAPAAHAQAGGEATASTTAWVDGIIRDIIGSSGGAAVSITQLIHNVREIIHPCNPGLASLLELRLRSLLAADPAPLPPPPQPQQHALLHGAPAAAPAGLTLPPPPPLPDKRRHEHPPPCQQQQQEEPHPAPQSPKAPTAEETAAAAAAAQAAAAAAAKERKEEQRRKQRDEEGLHLLTLLLQCAEAVNADNLDDAHQTLLEIAELATPFGTSTQRVAAYFAEAMSARLVSSCLGLYAPLPPGSPAAARLHGRVAAAFQVFNGISPFVKFSHFTANQAIQEAFEREERVHIIDLDIMQGLQWPGLFHILASRPGGPPRVRLTGLGASMEALEATGKRLSDFADTLGLPFEFCAVAEKAGNVDPEKLGVTRREAVAVHWLHHSLYDVTGSDSNTLWLIQRLAPKVVTMVEQDLSHSGSFLARFVEAIHYYSALFDSLDASYGEDSPERHVVEQQLLSREIRNVLAVGGPARTGDVKFGSWREKLAQSGFRAASLAGSAAAQASLLLGMFPSDGYTLVEENGALKLGWKDLCLLTASAWRPIQVPPCR

SEQ ID NO: 1145 - protein, 547 aa, Arabidopsis thaliana
MKRGYGETWDPPPKPLPASRSGEGPSMADKKKADDDNNNSNMDDELLAVLGYKVRSSEMAEVAQKLEQLEMVLSNDDVGSTVLNDSVHYNPSDLSNWVESMLSELNNPASSDLDTTRSCVDRSEYDLRAIPGLSAFPKEEEVFDEEASSKRIRLGSWCESSDESTRSVVLVDSQETGVRLVHALVACAEAIHQENLNLADALVKRVGTLAGSQAGAMGKVATYFAQALARRIYRDYTAETDVCAAVNPSFEEVLEMHFYESCPYLKFAHFTANQAILEAVTTARRVHVIDLGLNQGMQWPALMQALALRPGGPPSFRLTGIGPPQTENSDSLQQLGWKLAQFAQNMGVEFEFKGLAAESLSDLEPEMFETRPESETLVVNSVFELHRLLARSGSIEKLLNTVKAIKPSIVTVVEQEANHNGIVFLDRFNEALHYYSSLFDSLEDSYSLPSQDRVMSEVYLGRQILNVVAAEGSDRVERHETAAQWRIRMKSAGFDPIHLGSSAFKQASMLLSLYATGDGYRVEENDGCLMIGWQTRPLITTSAWKLA

SEQ ID NO: 1146 - protein, 523 aa, Arabidopsis thaliana
MKRSHQETSVEEEAPSMVEKLENGCGGGGDDNMDEFLAVLGYKVRSSDMADVAQKLEQLEMVLSNDIASSSNAFNDTVHYNPSDLSGWAQSMLSDLNYYPDLDPNRICDLRPITDDDECCSSNSNSNKRIRLGPWCDSVTSESTRSVVLIEETGVRLVQALVACAEAVQLENLSLADALVKRVGLLAASQAGAMGKVATYFAEALARRIYRIHPSAAAIDPSFEEILQMNFYDSCPYLKFAHFTANQAILEAVTTSRVVHVIDLGLNQGMQWPALMQALALRPGGPPSFRLTGVGNPSNREGIQELGWKLAQLAQAIGVEFKFNGLTTERLSDLEPDMFETRTESETLVVNSVFELHPVLSQPGSIEKLLATVKAVKPGLVTVVEQEANHNGDVFLDRFNEALHYYSSLFDSLEDGVVIPSQDRVMSEVYLGRQILNLVATEGSDRIERHETLAQWRKRMGSAGFDPVNLGSDAFKQASLLLALSGGGDGYRVEENDGSLMLAWQTKPLIAASAWKLAAELRR

SEQ ID NO: 1147 - protein, 587 aa, Arabidopsis thaliana
MKRDHHQFQGRLSNHGTSSSSSSISKDKMMMVKKEEDGGGNMDDELLAVLGYKVRSSEMAEVALKLEQLETMMSNVQEDGLSHLATDTVHYNPSELYSWLDNMLSELNPPPLPASSNGLDPVLPSPEICGFPASDYDLKVIPGNAIYQFPAIDSSSSSNNQNKRLKSCSSPDSMVTSTSTGTQIGGVIGTTVTTTTTTTTAAAESTRSVILVDSQENGVRLVHALMACAEAIQQNNLTLAEALVKQIGCLAVSQAGAMRKVATYFAEALARRIYRLSPPQNQIDHCLSDTLQMHFYETCPYLKFAHFTANQAILEAFEGKKRVHVIDFSMNQGLQWPALMQALALREGGPPTFRLTGIGPPAPDNSDHLHEVGCKLAQLAEAIHVEFEYRGFVANSLADLDASMLELRPSDTEAVAVNSVFELHKLLGRPGGIEKVLGVVKQIKPVIFTVVEQESNHNGPVFLDRFTESLHYYSTLFDSLEGVPNSQDKVMSEVYLGKQICNLVACEGPDRVERHETLSQWGNRFGSSGLAPAHLGSNAFKQASMLLSVFNSGQGYRVEESNGCLMLGWHTRPLITTSAWKLSTAAH

SEQ ID NO: 1148 - protein, 532 aa, Arabidopsis thaliana
MKRDHHHHHQDKKTMMMNEEDDGNGMDELLAVLGYKVRSSEMADVAQKLEQLEVMMSNVQEDDLSQLATETVHYNPAELYTWLDSMLTDLNPPSSNAEYDLKAIPGDAILNQFAIDSASSSNQGGGGDTYTTNKRLKCSNGVVETTTATAESTRHVVLVDSQENGVRLVHALLACAEAVQKENLTVAEALVKQIGFLAVSQIGAMRQVATYFAEALARRIYRLSPSQSPIDHSLSDTLQMHFYETCPYLKFAHFTANQAILEAFQGKKRVHVIDFSMSQGLQWPALMQALALRPGGPPVFRLTGIGPPAPDNFDYLHEVGCKLAHLAEAIHVEFEYRGFVANTLADLDASMLELRPSEIESVAVNSVFELHKLLGRPGAIDKVLGVVNQIKPEIFTVVEQESNHNSPIFLDRFTESLHYYSTLFDSLEGVPSGQDKVMSEVYLGKQICNVVACDGPDRVERHETLSQWRNRFGSAGFAAAHIGSNAFKQASMLLALFNGGEGYRVEESDGCLMLGWHTRPLIATSAWKLSTN

SEQ ID NO: 1149 - protein, 511 aa, Arabidopsis thaliana
MKREHNHRESSAGEGGSSSMTTVIKEEAAGVDELLVVLGYKVRSSDMADVAHKLEQLEMVLGDGISNLSDETVHYNPSDLSGWVESMLSDLDPTRIQEKPDSEYDLRAIPGSAVYPRDEHVTRRSKRTRIESELSSTRSVVVLDSQETGVRLVHALLACAEAVQQNNLKLADALVKHVGLLASSQAGAMRKVATYFAEGLARRIYRIYPRDDVALSSFSDTLQIHFYESCPYLKFAHFTANQAILEVFATAEKVHVIDLGLNHGLQWPALIQALALRPNGPPDFRLTGIGYSLTDIQEVGWKLGQLASTIGVNFEFKSIALNNLSDLKPEMLDIRPGLESVAVNSVFELHRLLAHPGSIDKFLSTIKSIRPDIMTVVEQEANHNGTVFLDRFTESLHYYSSLFDSLEGPPSQDRVMSELFLGRQILNLVACEGEDRVERHETLNQWRNRFGLGGFKPVSIGSNAYKQASMLLALYAGADGYNVEENEGCLLLGWQTRPLIATSAWRINRVE

SEQ ID NO: 1150 - protein, 623 aa, Triticum aestivum
MKREYQDAGGSGGGGGGMGSSEDKMMVSAAAGEGEEVDELLAALGYKVRASDMADVAQKLEQLEMAMGMGGVGAGAAPDDSFATHLATDTVHYNPTDLSSWVESMLSELNAPPPPLPPAPQLNASTSSTVTGSGGYFDLPPSVDSSSSIYALRPIPSPAGATAPADLSADSVRDPKRMRTGGSSTSSSSSSSSSLGGGARSSVVEAAPPVAAAANATPALPVVVVDTQEAGIRLVHALLACAEAVQQENLSAAEALVKQIPLLAASQGGAMRKVAAYFGEALARRVFRFRPQPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGEEDPNEEPEVIAVNSVFEMHRLLAQPGALEKVLGTVRAVRPRIVTVVEQEANHNSGTFLDRFTESLHYYSTMFDSLEGGSSGGGPSEVSSGAAAAPAAAGTDQVMSEVYLGRQICNVVACEGAERTERHETLGQWRNRLGNAGFETVHLGSNAYKQASTLLALFAGGDGYKVEEKEGCLTLGWHTRPLIATSAWRLAGP

SEQ ID NO: 1151 - protein, 625 aa, Oryza sativa
MKREYQEAGGSSGGGSSADMGSCKDKVMAGAAGEEEDVDELLAALGYKVRSSDMADVAQKLEQLEMAMGMGGVSAPGAADDGFVSHLATDTVHYNPSDLSSWVESMLSELNAPLPPIPPAPPAARHASTSSTVTGGGGSGFFELPAAADSSSSTYALRPISLPVVATADPSAADSARDTKRMRTGGGSTSSSSSSSSSLGGGASRGSVVEAAPPATQGAAAANAPAVPVVVVDTQEAGIRLVHALLACAEAVQQENFAAAEALVKQIPTLAASQGGAMRKVAAYFGEALARRVYRFRPADSTLLDAAFADLLHAHFYESCPYLKFAHFTANQAILEAFAGCHRVHVVDFGIKQGMQWPALLQALALRPGGPPSFRLTGVGPPQPDETDALQQVGWKLAQFAHTIRVDFQYRGLVAATLADLEPFMLQPEGEADANEEPEVIAVNSVFELHRLLAQPGALEKVLGTVHAVRPRIVTVVEQEANHNSGSFLDRFTESLHYYSTMFDSLEGGSSGQAELSPPAAGGGGGTDQVMSEVYLGRQICNVVACEGAERTERHETLGQWRNRLGRAGFEPVHLGSNAYKQASTLLALFAGGDGYRVEEKEGCLTLGWHTRPLIATSAWRVAAA

SEQ ID NO: 1152 - protein, 505 aa, Glycine max
MASSSSNGSSSGSKSWDIDGDLAGFGYKVRSSELQHVAENMERLENVMDIVNSSTNNNISQLASDTVFYNPSDIGSWVDTLLSEFDQTASLPYDFSDFLDLDTDQNQNHKPTLVTMEEDSGIRLVHTLMTCADSVQRGDLAFAGSLIENMQGLLAHVNTNIGIGKVAGYFIDALRRRILGQGVFQTLSSSSYPYEDNVLYHHYYEACPYLKFAHFTANQAILEAFNGHDCVHVIDFNLMQGLQWPALIQALALRPGGPPLLRLTGIGPPSSDNRDTLREIGLRLAELARSVNVRFAFRGVAAWRLEDVKPWMLQVNPNEAVAVNSIMQLHRLLASDSDPIGSGIETVLGWIRSLNPKIISVVEQEANHNQDRFLERFTEALHYYSTVFDSLEACPVEPDKALAEMYLQREICNVVSSEGPARVERHEPLAKWRERLEKAGFKPLHLGSNAYKQASMLLTLFSAEGYSVEENQGCLTLGWHSRPLIAASAWQAAPMQDRETLRFEQ

SEQ ID NO: 1153 - protein, 769 aa, Arabidopsis thaliana
MGSYPDGFPGSMDELDFNKDFDLPPSSNQTLGLANGFYLDDLDFSSLDPPEAYPSQNNNNNNINNKAVAGDLLSSSSDDADFSDSVLKYISQVLMEEDMEEKPCMFHDALALQAAEKSLYEALGEKYPSSSSASSVDHPERLASDSPDGSCSGGAFSDYASTTTTTSSDSHWSVDGLENRPSWLHTPMPSNFVFQSTSRSNSVTGGGGGGNSAVYGSGFGDDLVSNMFKDDELAMQFKKGVEEASKFLPKSSQLFIDVDSYIPMNSGSKENGSEVFVKTEKKDETEHHHHHSYAPPPNRLTGKKSHWRDEDEDFVEERSNKQSAVYVEESELSEMFDKILVCGPGKPVCILNQNFPTESAKVVTAQSNGAKIRGKKSTSTSHSNDSKKETADLRTLLVLCAQAVSVDDRRTANEMLRQIREHSSPLGNGSERLAHYFANSLEARLAGTGTQIYTALSSKKTSAADMLKAYQTYMSVCPFKKAAIIFANHSMMRFTANANTIHIIDFGISYGFQWPALIHRLSLSRPGGSPKLRITGIELPQRGFRPAEEFRRQVIAWLDTVSDTMFRLSTTQLLRNGETIQVEDLKLRQGEYVVVNSLFRFRNLLDETVLVNSPRDAVLKLIRKINPNVFIPAILSGNYNAPFFVTRFREALFHYSAVFDMCDSKLAREDEMRLMYEKEFYGREIVNVVACEGTERVERPETYKQWQARLIRAGFRQLPLEKELMQNLKLKIENGYDKNFDVDQNGNWLLQGWKGRIVYASSLWVPSSS

SEQ ID NO: 1154 - protein, 666 aa, Solanum lycopersicum
MEALFQEQLFPCADSFIFRHPSIPMDPRKEVIQNGLNNHPSFDQDYFSNHVVGVGDSSPPPQEEGEKDYSDAMYKFLSQMLMEEDDLENKPCMFHDCMALQAKERYLSDVLHGSENNYSPQSVIINPHDSSSFLSNYSPDSIESPQWDLNFESPASMSTLSNHDSFFTSFGNGHFEEGAVNVLQSGSSSNSPTGLREKKNRHRGDVAADQQRSNKQMATFVHDESEPLEMYDNVLLCLNNPYVEQHSATSITSYSPPNEAKKTSKVGRPRGGRKHSSIVKKEMVDLRALLTQCAQAMANYDSRTANELLMRIREHSTPHGDGTERLAHYLANALEARLSGTGTALYTAYAPSRISAANILKAYKAFIRACPFKLLSNIFANKYIRKVIAGAPKIHIIDFGILYGFQWPCLIQGLSMRAGGPPELRITGIDLPQPGFKPAGRVEETGRRLEKYCKRFSVPFVFKAIAKKWESITLEELEVQRDEVLVVNSLYRLGNIPDETVVPNSPRDAVLNLIRRIRPDLFIHGALNGTFNTPFFVTRFREALFHFSSLYDMFEATLPREDEDRKLFEEEVFARDAMNVIACEGTERVERPETYKQWQLRCVRAGFKQVPLDQEIVKIVRNKVRSEYHRDFSVDEDGHWMLQGWKGRVIYALSCWKPTKQSVKLV

SEQ ID NO: 1155 - protein, 718 aa, Arabidopsis thaliana
MITEPSLTGISGMVNRNRLSGLPDQPSSHSFTPVTLYDGFNYNLSSDHINTVVAAPENSVFIREEEEEEDPADDFDFSDAVLGYISQMLNEEDMDDKVCMLQESLDLEAAERSLYEAIGKKYPPSPERNLAFAERNSENLDRVVPGNYTGGDCIGFGNGGIKPLSSGFTLDFRNPQSCSSILSVPQSNGLITIYGDGIDESSKNNRENHQSVWLFRREIEEANRFNPEENELIVNFREENCVSKARKNSSRDEICVEEERSSKLPAVFGEDILRSDVVDKILVHVPGGESMKEFNALRDVLKKGVEKKKASDAQGGKRRARGRGRGRGRGGGGGQNGKKEVVDLRSLLIHCAQAVAADDRRCAGQLLKQIRLHSTPFGDGNQRLAHCFANGLEARLAGTGSQIYKGIVSKPRSAAAVLKAHQLFLACCPFRKLSYFITNKTIRDLVGNSQRVHVIDFGILYGFQWPTLIHRFSMYGSPKVRITGIEFPQPGFRPAQRVEETGQRLAAYAKLFGVPFEYKAIAKKWDAIQLEDLDIDRDEITVVNCLYRAENLHDESVKVESCRDTVLNLIGKINPDLFVFGIVNGAYNAPFFVTRFREALFHFSSIFDMLETIVPREDEERMFLEMEVFGREALNVIACEGWERVERPETYKQWHVRAMRSGLVQVPFDPSIMKTSLHKVHTFYHKDFVIDQDNRWLLQGWKGRTVMALSVWKPESKA

SEQ ID NO: 1156 - protein, 629 aa, Oryza sativa
MDSPEYCQTNSNITLDYINRILMEEDIDEKISIKKGQDALQATEKPFYDILGKAYPSSSKETAINGDSQADYPDNGSSSYHEQACSGSFVSDLLGSQDAHSITTDWSSEFDRLALQFRRGVEEAKRFIPNIEKLVDDPEKNGLYACKQTTETTEQKGKHENKIRNHPHDPHVEHIELMEARNSKHMAISTSETIRDEMFDSILLCNRQLPGEVANLRGMMAKEASDNPKKFQSKGYGKGQRKPHSSKKKQKEAIDLSVLLIQCAQAIASNNHPFASELLRKIRHHALPDGDGSQRLANCFADGLEARLAGTGSQMYEKLMAKQTSTRDMLKAYHLYFVACPFEMVTYYFSNKTIIDALEGKTTLHIVDFGILFGFQWPCLIQRLAKREGGPPKLRITGVDVPQPGFRPHERIEETGKRLAEYANMFNVPFQYHGIASRWETICIEDLSIDKDEVLIINCMSRMRKLGDETENIDSARDRVLHMMKRMNPQVFILGVVNGLYSSPFFLTRFREVLFHYSSLFDMLDNNVPRNHEARILVEKDLFGNDALNAVACEGAERIERPESYKQWQMRILRAGFKQRPVNQAILNRSVHYKEFYHEDFVIDEDSGWLLQGWKGRIIQALSTWKVET

SEQ ID NO: 1157 - protein, 736 aa, Oryza sativa
MVIELPFDNQYTTTETEQPHDGSSCSSQQQLSLYNYSPSDPQLFSQPTTGSRTYLSGAVTIPGICNDKSNLGQQQFQIDAALSLGYQRIRSSDALCYISRVLMEDVDERVDLHQGEAALQAAEKPFYDILGQVYPPSLNRLALHSANEPDTPDESSSRNNYHNRYHSSHSSFNMLQPLPTPLSPYSYGRSLFLPNQHLVSTAWTSTFGIPGFQIRRGAEEAKRFVPIIDKLVIDLDTDRGLSISKMTTKAKVGDKKRYAIFELTDQRHSPYTTDLDILEGRNSKRYAITYCEIIRNDMFDRVLLCYGVENFAEASNLRKIMTKQARKNSLNGQTRGSAQRKLRGMKQLKKDVVDLRNLLIHCAQAVAADDRISASELVKKIRQHSSPDGDSNQRLAFYLVDGLEARLAGIGSQVYRKLMASRTSAESLLKAYSLYLSACPFERASFAYANQTILDASKGQQPRKVHIVHFGICTGFQWPSLIQRLANEEGGPPKLRITGIDMPQPGFHPCEIIEETGKRLADYANLFKVPFQYQGIASRWETVQIEDLNIDKDEVLIVNCMFRMKNLGDEMVSMNSARDRVLKIMRMMNPRVFILGIVNGSYSSPFFITRFKEVLFHYSSLFDMIDANVPRDNEARKMIEGGLFGQEALNIIACEGAERTERPESYKQWQARCLKAGFKQLPVDPATLKEIINMKKGIYHEDFVADEDGAWLLQGWKGRVIYAISTWKPNESYLDQ

SEQ ID NO: 1158 - protein, 413 aa, Arabidopsis thaliana
MDNVRGSIMLQPLPEIAESIDDAICHELSMWPDDAKDLLLIVEAISRGDLKLVLVACAKAVSENNLLMARWCMGELRGMVSISGEPIQRLGAYMLEGLVARLAASGSSIYKSLQSREPESYEFLSYVYVLHEVCPYFKFGYMSANGAIAEAMKDEERIHIIDFQIGQGSQWIALIQAFAARPGGAPNIRITGVGDGSVLVTVKKRLEKLAKKFDVPFRFNAVSRPSCEVEVENLDVRDGEALGVNFAYMLHHLPDESVSMENHRDRLLRMVKSLSPKVVTLVEQECNTNTSPFLPRFLETLSYYTAMFESIDVMLPRNHKERINIEQHCMARDVVNIIACEGAERIERHELLGKWKSRFSMAGFEPYPLSSIISATIRALLRDYSNGYAIEERDGALYLGWMDRILVSSCAWK

SEQ ID NO: 1159 - protein, 541 aa, Oryza sativa
MSARASNHAYICSDDSQMPYYNNSVPSGGNGRFYITQNHQDAHYASSDDGSQKIGSSPQAFEAPYCTLESSSANGAHPAHSSASSHSISPISGSPLSHHDSHSDHTYNSPPSASCVTEITDLQIKLRELENAILGPELDIAYDSPESALQPNIMATPENWRQLLGINTGDLKQVIIACGKAVAENDVRLTELLISELGQMVSVSGDPLQRLGAYMLEGLVARLSSSGSKIYKSLKCKEPTSSELMSYMHLLYEICPFFKFGYMSANGAIAEAIKGENFVHIIDFQIAQGSQWMTLIQALAARPGGPPFLRITGIDDSNSAYARGGGLDIVGMRLYKVAQSFGLPFEFNAVPAASHEVYLEHLDIRVGEVIVVNFAYQLHHTPDESVSTENHRDRILRMVKSLSPRLVTLVEQESNTNTRPFFPRYLETLDYYTAMFESIDVALPRDDKRRMSAEQHCVARDIVNLIACEGAERVERHEVFGKWKARLTMAGFRPYPLSSVVNSTIKTLLHTYNSFYRLEERDGVLYLGWKNRVLVVSSAWC

SEQ ID NO: 1160 - protein, 558 aa, Solanum lycopersicum
MDSHHLVAYGVTGSDLSYSSCPTVSPLENRPFGTSKFDSGNSPLVNYFNSETFNTVSDYQEQPSCTENLSGASSSSGSSLDYNQYFHRPSPSEDHLPEAPYSRNMKHTLLQLESALMGPDKEAMKSSPYLGENMGAQTSGQRYKAWNKEAQVVRHQQSVVSILNGIQSDKRDNVMEDLPLQGVPSSNLKQLLIACARALAENKLDDFEILVAKARSVVSVTGDPIQRLGAYIVEGLVARKELSGTTIYRSLKCKEPAGKDLFSYMYILYEICPYLKFGYMAANGAIVEACRNEDRIHIIDFQIAQGTQWMTLLQALAARPGGAPYVRITGIDDPVSQYARGDGLAAVARRLSAISEEFNIAVEFHAVPVFAPEITWDMLDVRPGEALAVNFPLQLHHTPDESVDVNNPRDGLIRMIKSLSPKIVTLVEQESNTNTAPFLPRFVEALDYYHAMFESIDVTLLRDMKERINVEQHCLARDIVNVIACEGKERVERHELLGKWKSRFMMAGFQQYPLSSYVNSVIKDLMKRYSEHYTLVEKDGAMLLGWKERNLVSASAWF

SEQ ID NO: 1161 - protein, 42 aa, Zea mays
WRKYGKKAVKNSPNPRNYYRCSSEGCGVKKRVERDRDDPRYV

SEQ ID NO: 1162 - protein, 42 aa, Zea mays; identical to SEQ ID NO: 1161

SEQ ID NO: 1163 - protein, 42 aa, Sorghum bicolor; identical to SEQ ID NO: 1161

SEQ ID NO: 1164 - protein, 42 aa, Zea mays
WRKYGKKAVKSSPNPRNYYRCSSEGCGVKKRVERDRDDPRYV

SEQ ID NO: 1165 - protein, 42 aa, Oryza sativa
WRKYGKKAVKNSPNPRNYYRCSTEGCNVKKRVERDREDHRYV

SEQ ID NO: 1166 - protein, 42 aa, Oryza sativa
WRKYGKKAVKSSPNPRNYYRCSAAGCGVKKRVERDGDDPRYV

SEQ ID NO: 1167 - protein, 42 aa, Zea mays
WRKYGKKAVKSSPNPRNYYRCSTEGSGVKKRVERDSDDPRYV

SEQ ID NO: 1168 - protein, 42 aa, Oryza sativa
WRKYGKKSVKNSPNPRNYYRCSTEGCNVKKRVERDKNDPRYV

SEQ ID NO: 1169 - protein, 42 aa, Zea mays
WRKYGKKSVKNSPNPRNYYRCSTEGCNVKKRVERDRDDPRYV

SEQ ID NO: 1170 - protein, 42 aa, Hordeum vulgare
WRKYGKKSVKNSPNPRNYYRCSTEGCSVKKRVERDRDDPAYV

SEQ ID NO: 1171 - protein, 42 aa, Oryza sativa
WRKYGKKSVKNSPNPRNYYRCSTEGCNVKKRVERDKDDPSYV

SEQ ID NO: 1172 - protein, 42 aa, Zea mays; identical to SEQ ID NO: 1171

SEQ ID NO: 1173 - protein, 42 aa, Oryza sativa
WRKYGKKMVKNSPNPRNYYRCSSEGCRVKKRVERARDDARFV

SEQ ID NO: 1174 - protein, 42 aa, Lactuca sativa
WRKYGKKMVKNSPNPRNYYRCSAAGCSVKKRVERDVEDARYV

SEQ ID NO: 1175 - protein, 42 aa, Capsicum annuum
WRKYGKKMVKNSPNPRNYYRCSVEGCPVKKRVERDKEDSRYV

SEQ ID NO: 1176 - protein, 42 aa, Arabidopsis thaliana
WRKYGKKMVKNSPHPRNYYKCSVDGCPVKKRVERDRDDPSFV

SEQ ID NO: 1177 - protein, 42 aa, Arabidopsis thaliana
WRKYGKKSVKNNINKRNYYKCSSEGCSVKKRVERDGDDAAYV

SEQ ID NO: 1178 - protein, 42 aa, Solanum tuberosum
WRKYGKKMVKNSSNPRNYYKCSSGGCNVKKRVERDNEDSSYV

SEQ ID NO: 1179 - protein, 42 aa, Solanum lycopersicum
CRKYGKKMVKNNPNPRNYYKCSSGGCNVKKRVERDNKDSSYV

SEQ ID NO: 1180 - protein, 42 aa, Glycine max
WRKYGKKSVKSSPNLRNYYKCSSGGCSVKKRVERDRDDYSYV

SEQ ID NO: 1181 - protein, 42 aa, Glycine max
WRKYGKKTVKSSPNPRNYYKCSGEGCDVKKRVERDRDDSNYV

SEQ ID NO: 1182 - protein, 42 aa, Glycine max
WRKYGKKTVKNNPNPRNYYKCSGEGCNVKKRVERDRDDSNYV

SEQ ID NO: 1183 - protein, 42 aa, Arabidopsis thaliana
WRKYGKKPITGSPFPRHYHKCSSPDCNVKKKIERDTNNPDYI

SEQ ID NO: 1184 - protein, 42 aa, Arabidopsis thaliana
WRKYGQKAVKNSPFPRSYYRCTTASCNVKKRVERSFRDPSTV

SEQ ID NO: 1185 - protein, 42 aa, Arabidopsis thaliana
WRKYGQKPVKDSPFPRNYYRCTTTWCDVKKRVERSFSDPSSV

SEQ ID NO: 1186 - protein, 42 aa, Arabidopsis thaliana
WRKYGQKAVKNNPFPRSYYKCTEEGCRVKKQVQRQWGDEGVV

SEQ ID NO: 1187 - protein, 42 aa, Arabidopsis thaliana
WRKYGQKAVKNNKFPRSYYRCTYGGCNVKKQVQRLTVDQEVV

SEQ ID NO: 1188 - protein, 42 aa, Arabidopsis thaliana
WRKYGQKVVKNTQHPRSYYRCTQDKCRVKKRVERLADDPRMV

SEQ ID NO: 1189 - protein, 42 aa, Arabidopsis thaliana
WRKYGQKSVKHNAHPRSYYRCTYHTCNVKKQVQRLAKDPNVV

SEQ ID NO: 1190 - protein, 42 aa, Arabidopsis thaliana
WRKYGQKSVKNNAHPRSYYRCTYHTCNVKKQVQRLAKDPNVV

SEQ ID NO: 1191 - protein, 42 aa, Arabidopsis thaliana
WRKYGQKSVKNSLYPRSYYRCTQHMCNVKKQVQRLSKETSIV

SEQ ID NO: 1192 - protein, 42 aa, Arabidopsis thaliana
WRKYGQKAVKNSPYPRSYYRCTTVGCGVKKRVERSSDDPSIV

SEQ ID NO: 1193 - protein, 42 aa, Arabidopsis thaliana
WRKYGQKAVKNSPFPRSYYRCTNSRCTVKKRVERSSDDPSIV

SEQ ID NO: 1194 - protein, 42 aa, Arabidopsis thaliana
WRKYGQKAVKNSPYPRSYYRCTTQKCNVKKRVERSFQDPSIV

SEQ ID NO: 1195 - protein, 42 aa, Arabidopsis thaliana
WRKYGQKAVKNSPYPRSYYRCTTQKCNVKKRVERSYQDPTVV

SEQ ID NO: 1196 - protein, 42 aa, Arabidopsis thaliana
WRKYGQKAVKNSPYPRSYYRCTTQKCNVKKRVERSFQDPTVV

SEQ ID NO: 1197 - protein, 42 aa, Arabidopsis thaliana
WRKYGQKSIKNSPNPRSYYKCTNPICNAKKQVERSIDESNTY

SEQ ID NO: 1198 - protein, 369 aa, Oryza sativa
MAVEGFEEAIKCLENLKLESGEASLEQRVRPGINSILPAAACGDHHTAAGAGLPPGFRFHPTDEELLLHYLGKRAAAAPCPAPVIAEVDIYKYNPWELPAMAVFGESDGEWYFFSPRDRKYPNGVRPNRAAGSGYWKATGTDKPISISETQQTVLLGVKKALVFYRGRPPKGTKTSWIMHEYRLANAAASSSSSYTSNMKQLASSSSSSSSSASMRLDEWVLCRIYKKKEANQQLQHYIDMMMDDDNDDEHNLQVQQQQQQQAQSHRMPRPPSISDYLLDYSDDLPPSTDQTPSLHLGFTAVNEGNNKRHKTMEEYYSISISTADMLHASSSTSNNKSTQINFSSIFEPQTPAAAGHQLMSSHNDDTSI

SEQ ID NO: 1199 - protein, 400 aa, Oryza sativa
MAKTSLPPGFRFHPTDVELTVYYLKRKLLGKHLRCNAVSELDLYKFAPWDLPEKSSLQSKDREWYFFCPRDRKYSSGSRTNRSTEAGYWKATGKDRPVIYNSQTVGMKRTLVFHLGKPPRGDRTDWVMYEYRLEDKELSASGVKLDACVLCKIFQKSGPGPKIGEQYGAPFNEDDWNEANGELSSFAFSVPPCALESSNGRLNTAGQQLAVSDNIGSSLDHCSETNDKIAVGGCGTTSPSVPFDTIHTQQLADIISCFSTDLLNSVSRDGSLPDSTADYDNDNEVSSDDGEAIFNELDELDSQSDESISNHCNSCGEDLIPPTLEVLKTEQYLELNDLSFSLADDPDPCNLLLTTNLSDQNHPELETRFEQGSLVDICNTTNATISNAACSASTVGDHVT

SEQ ID NO: 1200 - protein, 356 aa, Arabidopsis thaliana
MGKTNLAPGFRFHPTDVELVRYYLKRKVMGKKFQVDAIAEVDIYKFEPPDLPDKSCLGTGDLKWYFFCPREKKYPKGGKANRSTECGYWKTTGRDRDVSYNDEVTGKIRTLIYHYGKIPRGDRTDWVIHEYRLEDKVLAQKNVPQDTYVLCVLFKKNGLGPRHGSQYGAPFKEEDWSDKEEEYTQNHLVAGPSKETSLAAKASHSYAPKDGLTGVISESCVSDVPPLTATVLPPLTSDVIAYNPFSSSPLLEVPQVSLDGGELNSMLDLFSVDNDDCLLFDDFDYHNEVRHPDGFVNKEAPVFLGDGNFSGMFDLSNDQVVELQDLIQSPTPHPPSPPAQASIPDDSRSNGQTKDD

SEQ ID NO: 1201 - protein, 549 aa, Arabidopsis thaliana; identical to SEQ ID NO: 690

SEQ ID NO: 1202 - protein, 159 aa, Brassica oleracea
MVGFRFRPTDVELVEHYLRPKNNGGGSTTSSQVDQVINTVDICNLDPWELPRKSSRIASSDQVWYFFGRKESRYNRGERQKRKTKSGYWKKTGNTLPITRKRGNHETIGEKRVLMFYMSGSRSNWVMHEYHASCLSPNDVHVLLPFFFLLSLCFCYHSV

SEQ ID NO: 1203 - protein, 394 aa, Arabidopsis thaliana; identical to SEQ ID NO: 20

SEQ ID NO: 1204 - protein, 342 aa, Arabidopsis thaliana; identical to SEQ ID NO: 10

SEQ ID NO: 1205 - protein, 350 aa, Arabidopsis thaliana; identical to SEQ ID NO: 22

SEQ ID NO: 1206 - protein, 359 aa, Arabidopsis thaliana; identical to SEQ ID NO: 24

SEQ ID NO: 1207 - protein, 451 aa, Arabidopsis thaliana
MKEDMEVLSLASLPVGFRFSPTDEELVRYYLRLKINGHDNDVRVIREIDICKWEPWDLPDFSVVKTTDSEWLFFCPLDRKYPSGSRMNRATVAGYWKATGKDRKIKSGKTKIIGVKRTLVFYTGRAPKGTRTCWIMHEYRATEKDLDGTKSGQNPFVVCKLFKKQDIVNGAAEPEESKSCEVEPAVSSPTVVDEVEMSEVSPVFPKTEETNPCDVAESSLVIPSECRSGYSVPEVTTTGLDDIDWLSFMEFDSPKLFSPLHSQVQSELGSSFNGLQSESSELFKNHNEDYIQTQYGTNDADEYMSKFLDSFLDIPYEPEQIPYEPQNLSSCNKINDESKRGIKIRARRAQAPGCAEQFVMQGDASRRLRLQVNLNSHKSETDSTQLQFIKKEVKDTTTETMTKGCGNFTRSKSRTSFIFKKIAAMGCSYRGLFRVGVVAVVCVMSVCSLVA

SEQ ID NO: 1208 - protein, 491 aa, Arabidopsis thaliana
MGAVSMESLPLGFRFRPTDEELVNHYLRLKINGRHSDVRVIPDIDVCKWEPWDLPALSVIKTDDPEWFFFCPRDRKYPNGHRSNRATDSGYWKATGKDRSIKSKKTLIGMKKTLVFYRGRAPKGERTNWIMHEYRPTLKDLDGTSPGQSPYVLCRLFHKPDDRVNGVKSDEAAFTASNKYSPDDTSSDLVQETPSSDAAVEKPSDYSGGCGYAHSNSTADGTMIEAPEENLWLSCDLEDQKAPLPCMDSIYAGDFSYDEIGFQFQDGTSEPDVSLTELLEEVFNNPDDFSCEESISRENPAVSPNGIFSSAKMLQSAAPEDAFFNDFMAFTDTDAEMAQLQYGSEGGASGWPSDTNSYYSDLVQQEQMINHNTENNLTEGRGIKIRARQPQNRQSTGLINQGIAPRRIRLQLQSNSEVKEREEVNEGHTVIPEAKEAAAKYSEKSGSLVKPQIKLRARGTIGQVKGERFADDEVQVQSTKRERERIKCSLM

SEQ ID NO: 1209 - protein, 211 aa, Brassica rapa
MESLPLGFRFRPTDEELINHYLRLKINGRDLEVRVIPEIDVCKWEPWDLPGLSVIKTDDQEWFFFCPRDRKYPSGHRSNRATDIGYWKATGKDRTIKSKKMIIGMKKTLVFYRGRAPIGERTNWIMHEYRATDKDLDGTGPGQSPYVLCRLFHKPSDVANCDEVENVNATPTTTRCSREDNSSEMVQETDTSRVHAQNISDDTERCPRDQG

SEQ ID NO: 1210 - protein, 652 aa, Arabidopsis thaliana
MNQIKNKTLPEMTTEQALLSMEALPLGFRFRPTDEELINHYLRLKINGRDLEVRVIPEIDVCKWEPWDLPGLSVIKTDDQEWFFFCPRDRKYPSGHRSNRATDIGYWKATGKDRTIKSKKMIIGMKKTLVFYRGRAPRGERTNWIMHEYRATDKELDGTGPGQNPYVLCRLFHKPSDSCDPAHCEEIEKVNFTPTTTTRCSPDDTSSEMVQETATSGVHALDRSDDTERCLSDKGNNDVKPDVSVINNTSVNHAETSRAKDRNLGKTLVEENPLLRDVPTLHGPILSEKSYYPGQSSIGFATSHMDSMYSSDFGNCDYGLHFQDGASEQDASLTDVLDEVFHNHNESSNDRKDFVLPNMMHWPGNTRLLSTEYPFLKDSVAFVDGSAEVSGSQQFVPDILASRWVSEQNVDSKEAVEILSSTGSSRTLTPLHNNVFGQYASSSYAAIDPFNYNVNQPEQSSFEQSHVDRNISPSNIFEFKARSRENQRDLDSVVDQGTAPRRIRLQIEQPLTPVTNKKERDADNYEEEDEVQSAMSKVVEEEPANLSAQGTAQRRIRLQTRLRKPLITLNNTKRNSNGREGEASHRKCEMQEKEDISSSSSWQKQKKSLVQFSSVVIIVAVIVVLVEIWKESRDAKCSFLFHQLDSFKGMFT

SEQ ID NO: 1211 - protein, 650 aa, Oryza sativa
MAPVSLPPGFRFHPTDEELIIYYLKRKINGRQIELEIIPEVDLYKCEPWDLPEKSFLPSKDLEWYFFSPRDRKYPNGSRTNRATKAGYWKATGKDRKVNSQRRAVGMKKTLVYYRGRAPHGSRTDWVMHEYRLDERECETDTGLQDAYALCRVFKKTAPGPKIIEHYGVVHHHVEQPQWMTSSIDRSPTLDVSCDGRGDDFESSSFSFPTETPMDSMHGGFGMQMSAPHEDGKWMQFLSEDAFNATNPFLTNPVSANFSCLPSKVDVALECARLQHRLTLPPLEVEDFPQDVSLDTKIGILRSNPNEVDILQEFLSVATASQELINGSTSSYPEMWLGASTSSASYVNELSSLVEMGGVGTSNHHESARLQVEIADMEVFKDEKKRVENLRGVKLVNNDLGEIVVEGDESNPTEDIIAQYPIKVTADNSGEAGHRMTDPTDVGGIDTAPIFSQSQPDDFAAGFDDVNPNASFDLYEKVDVNHRLFVSRVAAAKTFFHRIEPSKKVSFHSNPAATAVSKATEKFHFPVTTKVSGRVSIFSKFKALIRDKFLMMRPSHSYQRLGSKETTVNELLQIVSLLLAPKQINGCPTEQELVKKKAKEVMKPGWGREGSNKLWLPLSKGKGISSMFLSGKWTFLTSALAISTPAECDH

SEQ ID NO: 1212 - protein, 631 aa, Arabidopsis thaliana; identical to SEQ ID NO: 520

SEQ ID NO: 1213 - protein, 246 aa, Arabidopsis thaliana
MAPVGLPPGFRFHPTDEELVNYYLKRKINGQEIELDIIPEVDLYKCEPWDLAEKSFLPSRDPEWYFFGPRDRKYPNGFRTNRATRGGYWKSTGKDRRVTSQSRAIGMKKTLVYYKGRAPQGIRTDWVMHEYRLDDKDCDDPSSLQDSYALCRVFKKNGICSELESERQLQTGQCSFTTASMEEINSNNNNNYNNDYETMSPEVGVSSACVEEVVDDKDDSWMQFITDDAWDTSSNGAAMGHGQGVY

SEQ ID NO: 1214 - protein, 476 aa, Arabidopsis thaliana; identical to SEQ ID NO: 612

SEQ ID NO: 1215 - protein, 381 aa, Oryza sativa
MRLARQQQQVVVAATMEHDVHHHRQMMQQQQQQEMDLPPGFRFHPTDEELITHYLLRKAADPAGFAARAVGEADLNKCEPWDLPSRATMGEKEWYFFCVDKRKYPTGLRTNRATESGYWKATGKDREIFRGKALVGMKKTLVFYTGRAPRGGKTGWVMHEYRIHGKHAAANSKQDQEWVLCRVFKKSLELAPAAAAAVGRRGAGAGTDVGPSSMPMADDVVGLAPCALPPLMDVSGGGGGAGTTSLSATAGAAAAPPPAHVTCFSNALEGQFLDTPYLLPAADPADHLAMSSASPFLEALQMQYVQDAAAAGGAGMVHELLMGGGWYCNKGERERLSGASQDTGLTSSEVNPGEISSSSRHNAWIITTRPSGPIEIFIHHH

SEQ ID NO: 1216 - protein, 357 aa, Glycine max
MENVSVLLCNKEKDQMDLPPGFRFHPTDEELISHYLYRKVTDTNFSARAIGEVDLNRSEPWDLPWKAKMGEKEWYFFCVRDRKYPTGLRTNRATESGYWKATGKDKEIFRGKSLVGMKKTLVFYKGRAPKGEKTDWVMHEYRLDGKFSFHTLPKTAKNEWVICRVFQKSSGVKRTHISGMMMLDSYGNEMVYSSSALPPLTDSSPSIGNNTKALSVTDSAYVPCFSNPIDVPRGIFDSLNNINISINSNTLYGVSSNHSFYNTQGVQLQAPPTLPLPSSSNHYLRAFLENQGNGSNMSNNGFEPEREMVSVSQKTSLSTDVKAEISSLGKRHFENQNNPIASAAAVAPMDLATLWNY

SEQ ID NO: 1217 - protein, 329 aa, Arabidopsis thaliana
METFGVFHKEDDEQMDLPPGFRFHPTDEELITHYLHKKVLDLGFSAKAIGEVDLNKAEPWELPYKAKIGEKEWYFFCVRDRKYPTGLRTNRATQAGYWKATGKDKEIFRGKSLVGMKKTLVFYRGRAPKGQKTNWVMHEYRLDGKLSAHNLPKTAKNEWVICRVFHKTAGGKKIPISTLIRIGSYGTGSSLPPLTDSSPYNDKTKTEPVYVPCFSNQAETRGTILNCFSNPSLSSIQPDFLQMIPLYQPQSLNISESSNPVLTQEQSVLQAMMENNRRQNFKTLSISQETGVSNTDNSSVFEFGRKRFDHQEVPSPSSGPVDLEPFWNY

SEQ ID NO: 1218 - protein, 334 aa, Arabidopsis thaliana
METFCGFQKEEEQMDLPPGFRFHPTDEELITHYLHNKVLDTSFSAKAIGEVDLNKSEPWELPWMAKMGEKEWYFFCVRDRKYPTGLRTNRATEAGYWKATGKDKEIYRGKSLVGMKKTLVFYRGRAPKGQKTNWVMHEYRLEGKFSAHNLPKTAKKWVCRVFQKSAGGKKIPISSLIRIGSLGTDFNPSLLPSLTDSSPYNDKTKTEPVYVPCFSNQTDQNQGTTLNCFSSPVLNSIQADIFHRIPLYQTQSLQVSMNLQSPVLTQEHSVLHAMIENNRRQSLKTMSVSQETGVSTDMNTDISSDFEFGKRRFDSQEDPSSSTGPVDLEPFWNY

SEQ ID NO: 1219 - protein, 301 aa, Oryza sativa
MSESEVSVINQLEEEETRLELPPGFRFHPTDEEVVTHYLTRKAQDRSFSCVVIADVNLNNCEPWDLPSKAKMGEKEWFFFCHKDRKYPTGMRTNRATASGYWKATGKDKEIFRGRGLLVGMKKTLVFYMGRAPRGEKTPWVMHEYRLDGKLPPNLPRSAKEEWAVCRVFNKDLAAKIAQMPPPPFPRNDSFDLDLDDFLHLDADLPPLIDDPFASTSTLKTEPPPPANLMHNHYGYFSLPASATNYNHSSGAMADQAIRRFCKAEASTACFSGADADVDPVVDELLSFPDSITDYSYIWKA

SEQ ID NO: 1220 - protein, 335 aa, Arabidopsis thaliana
MAVVVEEGVVLNHGGEELVDLPPGFRFHPTDEEIITCYLKEKVLNSRFTAVAMGEADLNKCEPWDLPKRAKMGEKEFYFFCQRDRKYPTGMRTNRATESGYWKATGKDKEIFKGKGCLVGMKKTLVFYRGRAPKGEKTNWVMHEYRLEGKYSYYNLPKSARDEWVVCRVFHKNNPSTTTQPMTRIPVEDFTRMDSLENIDHLLDFSSLPPLIDPSFMSQTEQPNFKPINPPTYDISSPIQPHHFNSYQSIFNHQVFGSASGSTYNNNNEMIKMEQSLVSVSQETCLSSDVNANMTTTTEVSSGPVMKQEMGMMGMVNGSKSYEDLCDLRGDLWDF

SEQ ID NO: 1221 - protein, 364 aa, Arabidopsis thaliana; identical to SEQ ID NO: 954

SEQ ID NO: 1222 - protein, 401 aa, Oryza sativa
MAKTSLPPGFRFHPTDVELTVYYLKRKLLGKHLRCNAVSELDLYKFAPWDLPEKSSLQSKDREWYFFCPRDRKYSSGSRTNRSTEAGYWKATGKDRPVIYNSQTVGMKRTLVFHLGKPPRGGDRTDWVMYEYRLEDKELSASGVKLDACVLCKIFQKSGPGPKIGEQYGAPFNEDDWNEANGELSSFAFSVPPCALESSNGRLNTAGQQLAVSDNIGSSLDHCSETNDKIAVGGCGTTSPSVPFDTIHTQQLDEIISCFSTDLLNSVSRDGSLPDSTADYDNDNEVSSDDGEAIFNELDELDSQSDESISNHCNSCGEDLIPPTLEVLKTEQYLELNDLSFSLADDPDPCNLLLTTNLSDQNHPELETRFEQGSLVDICNTTNATISNAACSASTVGDHVT

SEQ ID NO: 1223 - protein, 356 aa, Arabidopsis thaliana; identical to SEQ ID NO: 1200

SEQ ID NO: 1224 - protein, 159 aa, Brassica oleracea; identical to SEQ ID NO: 1202

SEQ ID NO: 1225 - protein, 451 aa, Arabidopsis thaliana; identical to SEQ ID NO: 1207

SEQ ID NO: 1226 - protein, 491 aa, Arabidopsis thaliana; identical to SEQ ID NO: 1208

SEQ ID NO: 1227 - protein, 211 aa, Brassica rapa; identical to SEQ ID NO: 1209

SEQ ID NO: 1228 - protein, 652 aa, Arabidopsis thaliana; identical to SEQ ID NO: 1210

SEQ ID NO: 1229 - protein, 650 aa, Oryza sativa; identical to SEQ ID NO: 1211

SEQ ID NO: 1230 - protein, 246 aa, Arabidopsis thaliana; identical to SEQ ID NO: 1213

SEQ ID NO: 1231 - protein, 381 aa, Oryza sativa
MRLARQQQQVVVAATMEHDVHHHRQMMQQQQQQEMDLPPGFRFHPTDEELITHYLLRKAADPAGFAARAVGEADLNKCEPWDLPSRATMGEKEWYFFCVKDRKYPTGLRTNRATESGYWKATGKDREIFRGKALVGMKKTLVFYTGRAPRGGKTGWVMHEYRIHGKHAAANSKQDQEWVLCRVFKKSLELAPAAAAAVGRRGAGAGTDVGPSSMPMADDVVGLAPCALPPLMDVSGGGGGAGTTSLSATAGAAAAPPAAHVTCFSNALEGQFLDTPYLLPAADPADHLAMSSASPFLEALQMQYVQDAAAAGGAGMVHELLMGGGWYCNKGERERLSGASQDTGLTSSEVNPGEISSSSRHNAWIITTRPSGPIEIFIHHH

SEQ ID NO: 1232 - protein, 357 aa, Glycine max; identical to SEQ ID NO: 1216

SEQ ID NO: 1233 - protein, 329 aa, Arabidopsis thaliana; identical to SEQ ID NO: 1217

SEQ ID NO: 1234 - protein, 334 aa, Arabidopsis thaliana; identical to SEQ ID NO: 1218

SEQ ID NO: 1235 - protein, 301 aa, Oryza sativa; identical to SEQ ID NO: 1219

SEQ ID NO: 1236 - protein, 335 aa, Arabidopsis thaliana; identical to SEQ ID NO: 1220

SEQ ID NO: 1237 - protein, 45 aa, Arabidopsis thaliana
VKMSEEEEDLISRMYKLVGDRWELIAGRIPGRTPEEIERYWLMKH

SEQ ID NO: 1238 - protein, 84 aa, Arabidopsis thaliana
VKAHGKGHWNRIAKKTGLKRCGKSCRLRWMNYLSPNVKRGNFTEQEEDLIIRLHKLLGNRWSLIAKRVPGRTDNQVKNYWNTHL

SEQ ID NO: 1239 - protein, 84 aa, Arabidopsis thaliana
IKKEGEGRWRSLPKRAGLLRCGKSCRLRWMNYLRPSVKRGGITSDEEDLILRLHRLLGNRWSLIAGRIPGRTDNEIKNYWNTHL

SEQ ID NO: 1240 - protein, 84 aa, Arabidopsis thaliana
ITTHGEGKWSTLPNQAGLKRCGKSCRLRWKNYLRPGIKRGNISSDEEELIIRLHNLLGNRWSLIAGRLPGRTDNEIKNHWNSNL

SEQ ID NO: 1241 - protein, 84 aa, Arabidopsis thaliana
IDKYGEGKWHQVPLRAGLNRCRKSCRLRWLNYLKPSIKRGRLSNDEVDLLLRLHKLLGNRWSLIAGRLPGRTANDVKNYWNTHL

SEQ ID NO: 1242 - protein, 49 aa, Arabidopsis thaliana
LKWTAEEEEALLAGIRKHGPGKWKNILRDPEFADQLIHRSNIDLKDKWR

SEQ ID NO: 1243 - protein, 47 aa, Arabidopsis thaliana
ERWTEEEHNRFIEALRLYGRAWQKIEEHVATKTAVQIRSHAQKFFSK

SEQ ID NO: 1244 - protein, 45 aa, Arabidopsis thaliana
INMTEQEEDLIFRMYRLVGDRWDLIAGRVPGRQPEEIERYWIMRN

SEQ ID NO: 1245 - protein, 45 aa, Arabidopsis thaliana
ISMTEQEEDLISRMYRLVGNRWDLIAGRVVGRKANEIERYWIMRN

SEQ ID NO: 1246 - protein, 45 aa, Glycine max
IHMSEQEEDLIRRMYKLVGDKWNLIAGRIPGRKAEEIERFWIMRH

SEQ ID NO: 1247 - protein, 45 aa, Arabidopsis thaliana
IAMAQEEEDLICRMYKLVGERWDLIAGRIPGRTAEEIERFWVMKN

SEQ ID NO: 1248 - protein, 45 aa, Arabidopsis thaliana
VNMSQEEEDLVSRMHKLVGDRWELIAGRIPGRTAGEIERFWVMKN

SEQ ID NO: 1249 - protein, 45 aa, Oryza sativa
VHFTEEEEDIVFRMHRLVGNRWELIAGRIPGRTAEEVEKFWAIKH

SEQ ID NO: 1250 - protein, 45 aa, Oryza sativa
VHFTEEEEDLVFRMHRLVGNRWELIAGRIPGRTAKEVEMFWAVKH

SEQ ID NO: 1251 - protein, 45 aa, Zea mays; identical to SEQ ID NO: 1249

SEQ ID NO: 1252 - protein, 45 aa, Zea mays; identical to SEQ ID NO: 1250

SEQ ID NO: 1253 - protein, 45 aa, Glycine max
VEFSEDEETLIIRMYKLVGERWSIIAGRIPGRTAEEIEKYWTSRF

SEQ ID NO: 1254 - protein, 45 aa, Glycine max
VEFSEDEETLIIRMYKLVGERWSLIAGRIPGRTAEEIEKYWTSRF

SEQ ID NO: 1255 - protein, 45 aa, Glycine max
VEFSEAEEILIAMVYNLVGERWSLIAGRIPGRTAEEIEKYWTSRF

SEQ ID NO: 1256 - protein, 45 aa, Glycine max; identical to SEQ ID NO: 1255

SEQ ID NO: 1257 - protein, 45 aa, Glycine max; identical to SEQ ID NO: 1255

SEQ ID NO: 1258 - protein, 84 aa, Arabidopsis thaliana
VETHGEGNWADISRRSGLKRGGKSCRLRWKNYLRPNIKRGSMSPQEQDLIIRMHKLLGNRWSLIAGRLPGRTDNEVKNYWNTHL

SEQ ID NO: 1259 - protein, 85 aa, Arabidopsis thaliana
  misc_feature (3)..(41): Xaa can be any naturally occurring amino acid
  misc_feature (45)..(45): Xaa can be any naturally occurring amino acid
  misc_feature (47)..(47): Xaa can be any naturally occurring amino acid
  misc_feature (56)..(56): Xaa can be any naturally occurring amino acid
  misc_feature (72)..(72): Xaa can be any naturally occurring amino acid
  misc_feature (80)..(80): Xaa can be any naturally occurring amino acid
VEXXXXXXXXXXXXXXXXXXXXXXXXXXXXXXXXXXXXXXXFSEXEXEDLISRMYXLVGERWELIAGRIPGXRTAEEIEXYWTMR

SEQ ID NO: 1260 - protein, 16 aa, Arabidopsis thaliana
  misc_feature (3)..(3): Xaa can be K or R
  misc_feature (8)..(8): Xaa can be any naturally occurring amino acid
  misc_feature (11)..(11): Xaa can be any naturally occurring amino acid
PKXPAGRXKFXETRHP

SEQ ID NO: 1261 - protein, 5 aa, Arabidopsis thaliana
DSAWR

SEQ ID NO: 1262 - protein, 26 aa, Arabidopsis thaliana
  misc_feature (2)..(18): Xaa can be any naturally occurring amino acid
  misc_feature (25)..(25): Xaa can be any naturally occurring amino acid
VXXXXXXXXXXXXXXXXXAAVAHDXA

SEQ ID NO: 1263 - protein, 42 aa, Arabidopsis thaliana
  misc_feature (7)..(14): Xaa can be any naturally occurring amino acid
  misc_feature (18)..(19): Xaa can be any naturally occurring amino acid
  misc_feature (22)..(26): Xaa can be any naturally occurring amino acid
  misc_feature (30)..(30): Xaa can be any naturally occurring amino acid
  misc_feature (32)..(32): Xaa can be any naturally occurring amino acid
  misc_feature (34)..(39): Xaa can be any naturally occurring amino acid
  misc_feature (41)..(41): Xaa can be Y or F
RKYGKKXXXXXXXXRNYXXCSXXXXXVKKXVXRXXXXXXYXV

SEQ ID NO: 1264 - protein, 6 aa, Arabidopsis thaliana
  misc_feature (3)..(3): Xaa can be any naturally occurring amino acid
  misc_feature (5)..(5): Xaa can be any naturally occurring amino acid
  misc_feature (6)..(6): Xaa can be R or K
WFXNXX

SEQ ID NO: 1265 - protein, 51 aa, Arabidopsis thaliana
  misc_feature (2)..(18): Xaa can be any naturally occurring amino acid
  misc_feature (20)..(32): Xaa can be any naturally occurring amino acid
  misc_feature (34)..(45): Xaa can be any naturally occurring amino acid
  misc_feature (47)..(48): Xaa can be any naturally occurring amino acid
  misc_feature (50)..(50): Xaa can be N or H
KXXXXXXXXXXXXXXXXXWXXXXXXXXXXXXXCXXXXXXXXXXXXWXXNXK

SEQ ID NO: 1266 - protein, 52 aa, Arabidopsis thaliana
  misc_feature (2)..(18): Xaa can be any naturally occurring amino acid
  misc_feature (20)..(33): Xaa can be any naturally occurring amino acid
  misc_feature (35)..(46): Xaa can be any naturally occurring amino acid
  misc_feature (48)..(49): Xaa can be any naturally occurring amino acid
  misc_feature (51)..(51): Xaa can be N or H
KXXXXXXXXXXXXXXXXXWXXXXXXXXXXXXXXCXXXXXXXXXXXXWXXNXK

SEQ ID NO: 1267 - protein, 53 aa, Arabidopsis thaliana
  misc_feature (2)..(18): Xaa can be any naturally occurring amino acid
  misc_feature (20)..(34): Xaa can be any naturally occurring amino acid
  misc_feature (36)..(47): Xaa can be any naturally occurring amino acid
  misc_feature (49)..(50): Xaa can be any naturally occurring amino acid
  misc_feature (52)..(52): Xaa can be N or H
KXXXXXXXXXXXXXXXXXWXXXXXXXXXXXXXXXCXXXXXXXXXXXXWXXNXK

SEQ ID NO: 1268 - protein, 54 aa, Arabidopsis thaliana
  misc_feature (2)..(6): Xaa can be any naturally occurring amino acid
  misc_feature (8)..(8): Xaa can be any naturally occurring amino acid
  misc_feature (13)..(13): Xaa can be any naturally occurring amino acid
  misc_feature (15)..(15): Xaa can be any naturally occurring amino acid
  misc_feature (19)..(19): Xaa can be R or K
  misc_feature (21)..(25): Xaa can be any naturally occurring amino acid
  misc_feature (27)..(28): Xaa can be any naturally occurring amino acid
  misc_feature (30)..(30): Xaa can be any naturally occurring amino acid
  misc_feature (32)..(33): Xaa can be any naturally occurring amino acid
  misc_feature (38)..(41): Xaa can be any naturally occurring amino acid
  misc_feature (43)..(50): Xaa can be any naturally occurring amino acid
  misc_feature (52)..(52): Xaa can be any naturally occurring amino acid
KXXXXXHXRSIAXRXRRTXIXXXXXLXXLXPXXDKQTXXXXMXXXXXXXXKXLQ

SEQ ID NO: 1269 - protein, 55 aa, Arabidopsis thaliana
  misc_feature (2)..(6): Xaa can be any naturally occurring amino acid
  misc_feature (8)..(8): Xaa can be any naturally occurring amino acid
  misc_feature (13)..(13): Xaa can be any naturally occurring amino acid
  misc_feature (15)..(15): Xaa can be any naturally occurring amino acid
  misc_feature (19)..(19): Xaa can be R or K
  misc_feature (21)..(25): Xaa can be any naturally occurring amino acid
  misc_feature (27)..(28): Xaa can be any naturally occurring amino acid
  misc_feature (30)..(30): Xaa can be any naturally occurring amino acid
  misc_feature (32)..(33): Xaa can be any naturally occurring amino acid
  misc_feature (38)..(42): Xaa can be any naturally occurring amino acid
  misc_feature (44)..(51): Xaa can be any naturally occurring amino acid
  misc_feature (53)..(53): Xaa can be any naturally occurring amino acid
KXXXXXHXRSIAXRXRRTXIXXXXXLXXLXPXXDKQTXXXXXMXXXXXXXXKXLQ

SEQ ID NO: 1270 - protein, 68 aa, Arabidopsis thaliana
DQSKYKGIRRRKWGKWVSEIRVPGTRQRLWLGSFSTAEGAAVAHDVAFYCLHRPSSLDDESFNFPHLL

SEQ ID NO: 1271 - protein, 68 aa, Brassica oleracea
HQAKYKGIRRRKWGKWVSEIRVPATRERLWLGSFSTAEGAAVAHDVAFYCLHRPSSLDNEAFNFPHLL

SEQ ID NO: 1272 - protein, 66 aa, Brassica rapa subsp. Pekinensis
TQSKYKGIRRRKWGKWVSEIRVPGTRDRLWLGSFSTAEGAAVAHDVAFYCLHQPNSLESLNFPHLL

SEQ ID NO: 1273 - protein, 66 aa, Arabidopsis thaliana
SQSKYKGIRRRKWGKWVSEIRVPGTRDRLWLGSFSTAEGAAVAHDVAFFCLHQPDSLESLNFPHLL

SEQ ID NO: 1274 - protein, 66 aa, Glycine max
TNNKLKGVRRRKWGKWVSEIRVPGTQERLWLGTYATPEAAAVAHDVAVYCLSRPSSLDKLNFPETL

SEQ ID NO: 1275 - protein, 66 aa, Zinnia elegans
SQKTYKGVRCRRWGKWVSEIRVPGSRERLWLGTYSTPEGAAVAHDVASYCLKGNTSFHKLNIPSML

SEQ ID NO: 1276 - protein, 71 aa, Oryza sativa
ERCRYRGVRRRRWGKWVSEIRVPGTRERLWLGSYATPEAAAVAHDTAVYFLRGGAGDGGGGGATLNFPERA

SEQ ID NO: 1277 - protein, 73 aa, Oryza sativa
EMMRYRGVRRRRWGKWVSEIRVPGTRERLWLGSYATAEAAAVAHDAAVCLLRLGGGRRAAAGGGGGLNFPARA

SEQ ID NO: 1278 - protein, 71 aa, Oryza sativa
ERCRYRGVRRRRWGKWVSEIRVPGTRERLWLGSYATPEAAAVAHDTAVYFLRGGAGDGGGGGATAQLPGAR

SEQ ID NO: 1279 - protein, 66 aa, Arabidopsis thaliana
RRLFFEMFPILKVSYLLTNRAILEAMEGEKMVHVIDLDASEPAQWLALLQAFNSRPEGPPHLRITG

SEQ ID NO: 1280 - protein, 70 aa, Arabidopsis thaliana
FLNAIWGLSPKVMVVTEQDSDHNGSTLMERLLESLYTYAALFDCLETKVPRTSQDRIKVEKMLFGEEIKN

SEQ ID NO: 1281 - protein, 74 aa, Arabidopsis thaliana
CEGFERRERHEKLEKWSQRIDLAGFGNVPLSYYAMLQARRLLQGCGFDGYRIKEESGCAVICWQDRPLYSVSAW

SEQ ID NO: 1282 - protein, 66 aa, Lycopersicon esculentum
RKMFFEIFPFLKVAFVVTNQAIIEAMEGEKMVHIVDLNAAEPLQWRALLQDLSARPEGPPHLRITG

SEQ ID NO: 1283 - protein, 70 aa, Lycopersicon esculentum
FLNALWGLSPKVMVVTEQDANHNGTTLMERLSESLHFYAALFDCLESTLPRTSLERLKVEKMLLGEEIRN

SEQ ID NO: 1284 - protein, 74 aa, Lycopersicon esculentum
CEGIERKERHEKLEKWFQRFDTSGFGNVPLSYYAMLQARRLLQSYSCEGYKIKEDNGCVVICWQDRPLFSVSSW

SEQ ID NO: 1285 - protein, 66 aa, Glycine max
QKLFFELFPFLKVAFVLTNQAIIEAMEGEKVIHIIDLNAAEAAQWIALLRVLSAHPEGPPHLRITG

SEQ ID NO: 1286 - protein, 70 aa, Glycine max
FLNALWGLSPKVMVVTEQDCNHNGPTLMDRLLEALYSYAALFDCLESTVSRTSLERLRVEKMLFGEEIKN

SEQ ID NO: 1287 - protein, 74 aa, Glycine max
CEGSERKERHEKLEKWFQRFDLAGFGNVPLSYFGMVQARRFLQSYGCEGYRMRDENGCVLICWEDRPMYSISAW

SEQ ID NO: 1288 - protein, 66 aa, Glycine max
QKLFFELLPFLKFSYILTNQAIVEAMEGEKMVHIVDLYGAGPAQWISLLQVLSARPEGPPHLRITG

SEQ ID NO: 1289 - protein, 70 aa, Glycine max
FLNALWGLSPKVMVVTEQDFNHNCLTMMERLAEALFSYAAYFDCLESTVSRASMDRLKLEKMLFGEEIKN

SEQ ID NO: 1290 - protein, 74 aa, Glycine max
CEGCERKERHEKMDRWIQRLDLSGFANVPISYYGMLQGRRFLQTYGCEGYKMREECGRVMICWQERSLFSITAW

SEQ ID NO: 1291 - protein, 68 aa, Oryza sativa
RRHMFDVLPFLKLAYLTTNHAILEAMEGERFVHVVDFSGPAANPVQWIALFHAFRGRREGPPHLRITA

SEQ ID NO: 1292 - protein, 69 aa, Oryza sativa
FLSAVRSLSPKIMVMTEQEANHNGGAFQERFDEALNYYASLFDCLQRSAAAAAERARVERVLLGEEIRG

SEQ ID NO: 1293 - protein, 77 aa, Oryza sativa
CEGAERVERHERARQWAARMEAAGMERVGLSYSGAMEARKLLQSCGWAGPYEVRHDAGGHGFFFCWHKRPLYAVTAW

SEQ ID NO: 1294 - protein, 66 aa, Oryza sativa
RRHFLDLCPFLRLAGAAANQSILEAMESEKIVHVIDLGGADATQWLELLHLLAARPEGPPHLRLTS

SEQ ID NO: 1295 - protein, 70 aa, Oryza sativa
FLGALWGLSPKVMVVAEQEASHNAAGLTERFVEALNYYAALFDCLEVGAARGSVERARVERWLLGEEIKN

SEQ ID NO: 1296 - protein, 74 aa, Oryza sativa
CDGGERRERHERLERWARRLEGAGFGRVPLSYYALLQARRVAQGLGCDGFKVREEKGNFFLCWQDRALFSVSAW

SEQ ID NO: 1297 - protein, 70 aa, Oryza sativa
DVESLRGLSLKVMVVTEQEVSHNAAGLTERFVEALNYYAALFDCLEVGGARGSVERTRVERWLLGEEIKN

SEQ ID NO: 1298 - protein, 67 aa, Oryza sativa
CDGGERRERHERLEGAGFGRVPLSYYALLQARRVAQGLGCDGFKVREEKGNFFLCWQDRALFSVSAW

SEQ ID NO: 1299 - protein, 57 aa, Arabidopsis thaliana
DDGFKWRKYGKKSVKNNINKRNYYKCSSEGCSVKKRVERDGDDAAYVITTYEGVHNH

SEQ ID NO: 1300 - protein, 57 aa, Glycine max
DDGYKWRKYGKKSVKSSPNLRNYYKCSSGGCSVKKRVERDRDDYSYVITTYEGVHNH

SEQ ID NO: 1301 - protein, 57 aa, Zea mays
DDGFKWRKYGKKAVKNSPNPRNYYRCSSEGCGVKKRVERDRDDPRYVITTYDGVHNH

SEQ ID NO: 1302 - protein, 57 aa, Sorghum bicolor; identical to SEQ ID NO: 1301

SEQ ID NO: 1303 - protein, 57 aa, Zea mays; identical to SEQ ID NO: 1301

SEQ ID NO: 1304 - protein, 57 aa, Zea mays
DDGFKWRKYGKKAVKSSPNPRNYYRCSSEGCGVKKRVERDRDDPRYVITTYDGVHNH

SEQ ID NO: 1305 - protein, 57 aa, Lycopersicon esculentum
DDGFKCRKYGKKMVKNNPNPRNYYKCSSGGCNVKKRVERDNKDSSYVITTYEGIHNH

SEQ ID NO: 1306 - protein, 57 aa, Solanum tuberosum
DDGFKWRKYGKKMVKNSSNPRNYYKCSSGGCNVKKRVERDNEDSSYVITTYEGIHNH

SEQ ID NO: 1307 - protein, 57 aa, Hordeum vulgare
DDGYKWRKYGKKSVKNSPNPRNYYRCSTEGCSVKKRVERDRDDPAYVVTTYEGTHSH

SEQ ID NO: 1308 - protein, 57 aa, Lactuca sativa
DDGFKWRKYGKKMVKNSPNPRNYYRCSAAGCSVKKRVERDVEDARYVITTYEGIHNH

SEQ ID NO: 1309 - protein, 57 aa, Glycine max
DDGYKWRKYGKKTVKNNPNPRNYYKCSGEGCNVKKRVERDRDDSNYVLTTYDGVHNH

SEQ ID NO: 1310 - protein, 57 aa, Zea mays
DDGYKWRKYGKKSVKNSPNPRNYYRCSTEGCNVKKRVERDKDDPSYVVTTYEGMHNH

SEQ ID NO: 1311 - protein, 57 aa, Oryza sativa
DDGFKWRKYGKKAVKNSPNPRNYYRCSTEGCNVKKRVERDREDHRYVITTYDGVHNH

SEQ ID NO: 1312 - protein, 57 aa, Zea mays
DDGYKWRKYGKKSVKNSPNPRNYYRCSTEGCNVKKRVERDRDDPRYVVTMYEGVHNH

SEQ ID NO: 1313 - protein, 57 aa, Oryza sativa
DDGYKWRKYGKKSVKNSPNPRNYYRCSTEGCNVKKRVERDKDDPSYVVTTYEGTHNH

SEQ ID NO: 1314 - protein, 57 aa, Capsicum annuum
DDGYKWRKYGKKMVKNSPNPRNYYRCSVEGCPVKKRVERDKEDSRYVITTYEGVHNH

SEQ ID NO: 1315 - protein, 57 aa, Arabidopsis thaliana
DDGFKWRKYGKKMVKNSPHPRNYYKCSVDGCPVKKRVERDRDDPSFVITTYEGSHNH

SEQ ID NO: 1316 - protein, 57 aa, Glycine max
DDGYKWRKYGKKTVKSSPNPRNYYKCSGEGCDVKKRVERDRDDSNYVLTTYDGVHNH

SEQ ID NO: 1317 - protein, 57 aa, Oryza sativa
DDGFKWRKYGKKAVKSSPNPRNYYRCSAAGCGVKKRVERDGDDPRYVVTTYDGVHNH

SEQ ID NO: 1318 - protein, 57 aa, Zea mays
DDGFKWRKYGKKAVKSSPNPRNYYRCSTEGSGVKKRVERDSDDPRYVVTTYDGVHNH

SEQ ID NO: 1319 - protein, 57 aa, Oryza sativa
DDGYKWRKYGKKSVKNSPNPRNYYRCSTEGCNVKKRVERDKNDPRYVVTMYEGIHNH

SEQ ID NO: 1320 - protein, 57 aa, Oryza sativa
DDGYRWRKYGKKMVKNSPNPRNYYRCSSEGCRVKKRVERARDDARFVVTTYDGVHNH

SEQ ID NO: 1321 - protein, 57 aa, Arabidopsis thaliana
DDGYKWRKYGKKPITGSPFPRHYHKCSSPDCNVKKKIERDTNNPDYILTTYEGRHNH

SEQ ID NO: 1322 - protein, 65 aa, Arabidopsis thaliana
KQARFRGVRRRPWGKFAAEIRDPSRNGARLWLGTFETAEEAARAYDRAAFNLRGHLAILNFPNEY

SEQ ID NO: 1323 - protein, 65 aa, Glycine max
EEPRYRGVRRRPWGKFAAEIRDPARHGARVWLGTFLTAEEAARAYDRAAYEMRGALAVLNFPNEY

SEQ ID NO: 1324 - protein, 65 aa, Glycine max
VEVRYRGIRRRPWGKFAAEIRDPTRKGTRIWLGTFDTAEQAARAYDAAAFHFRGHRAILNFPNEY

SEQ ID NO: 1325 - protein, 65 aa, Glycine max
CEVRYRGIRRRPWGKFAAEIRDPTRKGTRIWLGTFDTAEQAARAYDAAAFHFRGHRAILNFPNEY

SEQ ID NO: 1326 - protein, 65 aa, Medicago truncatula
DQIKYRGIRRRPWGKFAAEIRDPTRKGTRIWLGTFDTAEQAARAYDAAAFHFRGHRAILNFPNEY

SEQ ID NO: 1327 - protein, 65 aa, Arabidopsis thaliana
NEMKYRGVRKRPWGKYAAEIRDSARHGARVWLGTFNTAEDAARAYDRAAFGMRGQRAILNFPHEY

SEQ ID NO: 1328 - protein, 65 aa, Oryza sativa
ETTKYRGVRRRPSGKFAAEIRDSSRQSVRVWLGTFDTAEEAARAYDRAAYAMRGHLAVLNFPAEA

SEQ ID NO: 1329 - protein, 65 aa, Oryza sativa
TATKYRGVRRRPWGKFAAEIRDPERGGARVWLGTFDTAEEAARAYDRAAYAQRGAAAVLNFPAAA

SEQ ID NO: 1330 - protein, 65 aa, Arabidopsis thaliana
EQGKYRGVRRRPWGKYAAEIRDSRKHGERVWLGTFDTAEDAARAYDRAAYSMRGKAAILNFPHEY

SEQ ID NO: 1331 - protein, 65 aa, Oryza sativa
LVAKYRGVRRRPWGKFAAEIRDSSRHGVRVWLGTFDTAEEAARAYDRSAYSMRGANAVLNFPADA

SEQ ID NO: 1332 - protein, 65 aa, Oryza sativa
SSSSYRGVRKRPWGKFAAEIRDPERGGARVWLGTFDTAEEAARAYDRAAFAMKGATAMLNFPGDH

SEQ ID NO: 1333 - protein, 65 aa, Zea mays
KEGKYRGVRKRPWGKFAAEIRDPERGGSRVWLGTFDTAEEAARAYDRAAFAMKGATAVLNFPASG

SEQ ID NO: 1334 - protein, 65 aa, Oryza sativa
AASKYRGVRRRPWGKFAAEIRDPERGGSRVWLGTFDTAEEAARAYDRAAFAMKGAMAVLNFPGRT

SEQ ID NO: 1335 - protein, 65 aa, Arabidopsis thaliana
EHGKYRGVRRRPWGKYAAEIRDSRKHGERVWLGTFDTAEEAARAYDQAAYSMRGQAAILNFPHEY

SEQ ID NO: 1336 - protein, 65 aa, Zea mays
EPTKYRGVRRRPSGKFAAEIRDSSRQSVRMWLGTFDTAEEAARAYDRAAYAMRGQIAVLNFPAEA

SEQ ID NO: 1337 - protein, 65 aa, Zea mays
EPTKYRGVRRRPWGKYAAEIRDSSRHGVRIWLGTFDTAEEAARAYDRSANSMRGANAVLNFPEDA

SEQ ID NO: 1338 - protein, 65 aa, Triticum aestivum
EPTKYRGVRRRPWGKFAAEIRDSSRHGVRMWLGTFDTAEEAAAAYDRSAYSMRGRNAVLNFPDRA

SEQ ID NO: 1339 - protein, 65 aa, Zea mays
EPTKYRGVRRRPWGKYAAEIRDSSRHGVRIWLGTFDTAEEAARAYDRSAYSMRGANAVLNFPEDA

SEQ ID NO: 1340 - protein, 147 aa, Arabidopsis thaliana
GLRFRPTDKEIVVDYLRPKNSDRDTSHVDRVISTVTIRSFDPWELPCQSRIKLKDESWCFFSPKENKYGRGDQQIRKTKSGYWKITGKPKPILRNRQEIGEKKVLMFYMSKELGGSKSDWVMHEYHAFSPTQMMMTYTICKVMFKGD

SEQ ID NO: 1341 - protein, 144 aa, Arabidopsis thaliana
GLRFCPTDEEIVVDYLWPKNSDRDTSHVDRFINTVPVCRLDPWELPCQSRIKLKDVAWCFFRPKENKYGRGDQQMRKTKSGFWKSTGRPKPIMRNRQQIGEKKILMFYTSKESKSDWVIHEYHGFSHNQMMMTYTLCKVMFNGG

SEQ ID NO: 1342 - protein, 148 aa, Arabidopsis thaliana
GFRFRPNDEEIVDHYLRPKNLDSDTSHVDEVISTVDICSFEPWDLPSKSMIKSRDGVWYFFSVKEMKYNRGDQQRRRTNSGFWKKTGKTMTVMRKRGNREKIGEKRVLVFKNRDGSKTDWVMHEYHATSLFPNQMMTYTVCKVEFKGE

SEQ ID NO: 1343 - protein, 136 aa, Arabidopsis thaliana
GFRFRPTDGEIVDIYLRPKNLESNTSHVDEVISTVDICSFDPWDLPSHSRMKTRDQVWYFFGRKENKYGKGDRQIRKTKSGFWKKTGVTMDIMRKTGDREKIGEKRVLVFKNHGGSKSDWAMHEYHATFSSPNQGE

SEQ ID NO: 1344 - protein, 54 aa, Arabidopsis thaliana
ARYRECQKNHAASSGGHVVDGCGEFMSSGEEGTVESLLCAACDCHRSFHRKEID

SEQ ID NO: 1345 - protein, 64 aa, Arabidopsis thaliana; identical to SEQ ID NO: 1064

SEQ ID NO: 1346 - protein, 54 aa, Arabidopsis thaliana
VRYRECLKNHAASVGGSVHDGCGEFMPSGEEGTIEALRCAACDCHRNFHRKEMD

SEQ ID NO: 1347 - protein, 64 aa, Arabidopsis thaliana; identical to SEQ ID NO: 1065

SEQ ID NO: 1348 - protein, 54 aa, Arabidopsis thaliana
AKYRECQKNHAASTGGHVVDGCCEFMAGGEEGTLGALKCAACNCHRSFHRKEVY

SEQ ID NO: 1349 - protein, 64 aa, Arabidopsis thaliana; identical to SEQ ID NO: 1063

SEQ ID NO: 1350 - protein, 54 aa, Lotus corniculatus
VRYRECQKNHAVSFGGHAVDGCCEFMAAGDEGTLEAVICAACNCHRNFHRKEID

SEQ ID NO: 1351 - protein, 64 aa, Lotus corniculatus
KKRYRTKFTPEQKEKMLAFAEELGWRIQKHQEAAVEQFCAETCVRRNVLKVWMHNNKNTLGKKP

SEQ ID NO: 1352 - protein, 54 aa, Oryza sativa
ARYRECLKNHAVGIGGHAVDGCGEFMASGEEGSIDALRCAACGCHRNFHRKESE

SEQ ID NO: 1353 - protein, 64 aa, Oryza sativa
KKRFRTKFTQEQKDKMLAFAERLGWRIQKHDEAAVQQFCEEVCVKRHVLKVWMHNNKHTLGKKA

SEQ ID NO: 1354 - protein, 54 aa, Lotus corniculatus
IRYRECLRNHAARLGSHVTDGCGEFMPNGEQGTPESLICAACECHRNFHRKEAQ

SEQ ID NO: 1355 - protein, 64 aa, Lotus corniculatus
KKRFRTKFTQQQKDRMMEFAEKLGWKIQKQDEEEVKQFCSHVGVKRQAFKVWMHNSKQAMKKKQ

SEQ ID NO: 1356 - protein, 54 aa, Oryza sativa
GRYRECLKNHAVGIGGHAVDGCGEFMAAGEEGTIDALRCAACNCHRNFHRKESE

SEQ ID NO: 1357 - protein, 64 aa, Oryza sativa
KKRFRTKFTQEQKDKMLAFAERVGWRIQKHDEAAVQQFCDEVGVKRHVLKVWMHNNKHTLGKKL

SEQ ID NO: 1358 - protein, 54 aa, Arabidopsis thaliana
IRYRECLKNHAVNIGGHAVDGCCEFMPSGEDGTLDALKCAACGCHRNFHRKETE

SEQ ID NO: 1359 - protein, 64 aa, Arabidopsis thaliana; identical to SEQ ID NO: 1066

SEQ ID NO: 1360 - protein, 54 aa, Oryza sativa
ARYRECLKNHAAAIGGSATDGCGEFMPGGEEGSLDALRCSACGCHRNFHRKELD

SEQ ID NO: 1361 - protein, 64 aa, Oryza sativa
RKRFRTKFTAEQKARMLGFAEEVGWRLQKLEDAVVQRFCQEVGVKRRVLKVWMHNNKHTLARRH

SEQ ID NO: 1362 - protein, 54 aa, Brassica napus
VRYRECLKNHAVNIGGHAVDGCCEFMPSGEDGSLDALKCAACGCHRNFHRKETE

SEQ ID NO: 1363 - protein, 64 aa, Brassica napus
AKRFRTKFTAEQKDKMLAFAERLGWRIQKHDDAAVEQFCAETGVRRQVLKIWMHNNKNSLGRKP

SEQ ID NO: 1364 - protein, 53 aa, Oryza sativa
WRYRECLKNHAARMGAHVLDGCGEFMSSPGDGAAALACAACGCHRSFHRREPA

SEQ ID NO: 1365 - protein, 64 aa, Oryza sativa
KKRFRTKFTAEQKERMREFAHRVGWRIHKPDAAAVDAFCAQVGVSRRVLKVWMHNNKHLAKTPP

SEQ ID NO: 1366 - protein, 54 aa, Flaveria bidentis
YRYKECLKNHAVGIGGQAVDGCGEFMAAGDEGTLDALKCAACNCHRNFHRKEVE

SEQ ID NO: 1367 - protein, 64 aa, Flaveria bidentis
KKRFRTKFTQDQKDRMLAFSEALGWRIQKHDEAAVQQFCNETGVKRHVLKVWMHNNKHTIGKKP

SEQ ID NO: 1368 - protein, 54 aa, Arabidopsis thaliana
FRFRECLKNQAVNIGGHAVDGCGEFMPAGIEGTIDALKCAACGCHRNFHRKELP

SEQ ID NO: 1369 - protein, 64 aa, Arabidopsis thaliana
RKRHRTKFTAEQKERMLALAERIGWRIQRQDDEVIQRFCQETGVPRQVLKVWLHNNKHTLGKSP

SEQ ID NO: 1370 - protein, 54 aa, Arabidopsis thaliana
IKYKECLKNHAAAMGGNATDGCGEFMPSGEDGSIEALTCSACNCHRNFHRKEVE

SEQ ID NO: 1371 - protein, 64 aa, Arabidopsis thaliana
KKRFRTKFTPEQKEKMLSFAEKVGWKIQRQEDCVVQRFCEEIGVKRRVLKVWMHNNKIHFSKKN

SEQ ID NO: 1372 - protein, 51 aa, Oryza sativa
CRYHECLRNHAAASGGHVVDGCGEFMPASTEEPLACAACGCHRSFHRRDPS

SEQ ID NO: 1373 - protein, 64 aa, Oryza sativa
RRRSRTTFTREQKEQMLAFAERVGWRIQRQEEATVEHFCAQVGVRRQALKVWMHNNKHSFKQKQ

SEQ ID NO: 1374 - protein, 54 aa, Arabidopsis thaliana
IKYKECLKNHAATMGGNAIDGCGEFMPSGEEGSIEALTCSVCNCHRNFHRRETE

SEQ ID NO: 1375 - protein, 64 aa, Arabidopsis thaliana; identical to SEQ ID NO: 1070

SEQ ID NO: 1376 - protein, 56 aa, Arabidopsis thaliana
ATYKECLKNHAAGIGGHALDGCGEFMPSPSFNSNDPASLTCAACGCHRNFHRREED

SEQ ID NO: 1377 - protein, 64 aa, Arabidopsis thaliana; identical to SEQ ID NO: 1072

SEQ ID NO: 1378 - protein, 56 aa, Zea mays
PLYRECLKNHAASLGGHAVDGCGEFMPSPGANPADPTSLKCAACGCHRNFHRRTLE

SEQ ID NO: 1379 - protein, 64 aa, Zea mays
RKRFRTKFTAEQKQRMQELSERLGWRLQKRDEAIVDEWCRDIGVGKGVFKVWMHNNKHNFLGGH

SEQ ID NO: 1380 - protein, 53 aa, Oryza sativa
VRYHECLRNHAAAMGGHVVDGCREFMPMPGDAADALKCAACGCHRSFHRKDDG

SEQ ID NO: 1381 - protein, 64 aa, Oryza sativa
RKRFRTKFTPEQKEQMLAFAERVGWRMQKQDEALVEQFCAQVGVRRQVFKVWMHNNKSSIGSSS

SEQ ID NO: 1382 - protein, 56 aa, Arabidopsis thaliana
VTYKECLKNHAAAIGGHALDGCGEFMPSPSSTPSDPTSLKCAACGCHRNFHRRETD

SEQ ID NO: 1383 - protein, 64 aa, Arabidopsis thaliana; identical to SEQ ID NO: 1074

SEQ ID NO: 1384 - protein, 56 aa, Arabidopsis thaliana
FTYKECLKNHAAALGGHALDGCGEFMPSPSSISSDPTSLKCAACGCHRNFHRRDPD

SEQ ID NO: 1385 - protein, 64 aa, Arabidopsis thaliana; identical to SEQ ID NO: 1073

SEQ ID NO: 1386 - protein, 52 aa, Arabidopsis thaliana
PHYYECRKNHAADIGTTAYDGCGEFVSSTGEEDSLNCAACGCHRNFHREELI

SEQ ID NO: 1387 - protein, 64 aa, Arabidopsis thaliana; identical to SEQ ID NO: 1062

SEQ ID NO: 1388 - protein, 56 aa, Arabidopsis thaliana
VCYKECLKNHAANLGGHALDGCGEFMPSPTATSTDPSSLRCAACGCHRNFHRRDPS

SEQ ID NO: 1389 - protein, 64 aa, Arabidopsis thaliana; identical to SEQ ID NO: 1071

SEQ ID NO: 1390 - protein, 50 aa, Oryza sativa
GKYKECMRNHAAAMGGQAFDGCGEYMPASPDSLKCAACGCHRSFHRRAAA

SEQ ID NO: 1391 - protein, 64 aa, Oryza sativa
RKRFRTKFTPEQKERMREFAEKQGWRINRNDDGALDRFCVEIGVKRHVLKVWMHNHKNQLASSP

SEQ ID NO: 1392 - protein, 56 aa, Arabidopsis thaliana
VLYNECLKNHAVSLGGHALDGCGEFTPKSTTILTDPPSLRCDACGCHRNFHRRSPS

SEQ ID NO: 1393 - protein, 64 aa, Arabidopsis thaliana; identical to SEQ ID NO: 1068

SEQ ID NO: 1394 - protein, 52 aa, Oryza sativa
EVYRECMRNHAAKLGTYANDGCCEYTPDDGHPAGLLCAACGCHRNFHRKDFL

SEQ ID NO: 1395 - protein, 70 aa, Oryza sativa
RRRTRTKFTEEQKARMLRFAERLGWRMPKREPGRAPGDDEVARFCREIGVNRQVFKVWMHNHKAGGGGGG

SEQ ID NO: 1396 - protein, 40 aa, Oryza sativa
MGAHVLDGCGEFMSSPGDGAAALACAACGCHRSFHRREPA

SEQ ID NO: 1397 - protein, 64 aa, Oryza sativa
KKRFRTKFTAEQKERMREFAHRVGWRIHKPDAAAVDAFCAQVGVSRRVLKVWMHNNKLLAKTPP

SEQ ID NO: 1398 - protein, 49 aa, Arabidopsis thaliana
CVYRECMRNHAAKLGSYAIDGCREYSQPSTGDLCVACGCHRSYHRRIDV

SEQ ID NO: 1399 - protein, 63 aa, Arabidopsis thaliana
QRRRKSKFTAEQREAMKDYAAKLGWTLKDKRALREEIRVFCEGIGVTRYHFKTWVNNNKKFYH

SEQ ID NO: 1400 - protein, 59 aa, Arabidopsis thaliana; identical to SEQ ID NO: 1125

SEQ ID NO: 1401 - protein, 59 aa, Glycine max; identical to SEQ ID NO: 1122

SEQ ID NO: 1402 - protein, 59 aa, Glycine max; identical to SEQ ID NO: 1122

SEQ ID NO: 1403 - protein, 59 aa, Glycine max; identical to SEQ ID NO: 1124

SEQ ID NO: 1404 - protein, 59 aa, Oryza sativa; identical to SEQ ID NO: 1126

SEQ ID NO: 1405 - protein, 59 aa, Zea mays; identical to SEQ ID NO: 1128

SEQ ID NO: 1406 - protein, 59 aa, Arabidopsis thaliana; identical to SEQ ID NO: 1129

SEQ ID NO: 1407 - protein, 59 aa, Glycine max; identical to SEQ ID NO: 1130

SEQ ID NO: 1408 - protein, 59 aa, Oryza sativa; identical to SEQ ID NO: 1127

SEQ ID NO: 1409 - protein, 60 aa, Pinus taeda; identical to SEQ ID NO: 1121

SEQ ID NO: 1410 - protein, 59 aa, Oryza sativa; identical to SEQ ID NO: 1137

SEQ ID NO: 1411 - protein, 59 aa, Glycine max; identical to SEQ ID NO: 1131

SEQ ID NO: 1412 - protein, 59 aa, Glycine max; identical to SEQ ID NO: 1120

SEQ ID NO: 1413 - protein, 59 aa, Arabidopsis thaliana; identical to SEQ ID NO: 1118

SEQ ID NO: 1414 - protein, 59 aa, Oryza sativa; identical to SEQ ID NO: 1132

SEQ ID NO: 1415 - protein, 59 aa, Glycine max; identical to SEQ ID NO: 1138

SEQ ID NO: 1416 - protein, 59 aa, Glycine max; identical to SEQ ID NO: 1139

SEQ ID NO: 1417 - protein, 59 aa, Glycine max; identical to SEQ ID NO: 1134

SEQ ID NO: 1418 - protein, 59 aa, Arabidopsis thaliana; identical to SEQ ID NO: 1119

SEQ ID NO: 1419 - protein, 59 aa, Oryza sativa; identical to SEQ ID NO: 1133

SEQ ID NO: 1420 - protein, 59 aa, Arabidopsis thaliana; identical to SEQ ID NO: 1135

SEQ ID NO: 1421 - protein, 59 aa, Arabidopsis thaliana; identical to SEQ ID NO: 1136

SEQ ID NO: 1422 - protein, 35 aa, Arabidopsis thaliana
  misc_feature (2)..(10): Xaa can be any naturally occurring amino acid
  misc_feature (14)..(15): Xaa can be any naturally occurring amino acid
  misc_feature (17)..(18): Xaa can be any naturally occurring amino acid
  misc_feature (23)..(24): Xaa can be any naturally occurring amino acid
  misc_feature (27)..(31): Xaa can be any naturally occurring amino acid
  misc_feature (33)..(34): Xaa can be any naturally occurring amino acid
EXXXXXXXXXLVGXXWXXIAGRXXGRXXXXXEXXW

SEQ ID NO: 1423 - protein, 45 aa, Arabidopsis thaliana; identical to SEQ ID NO: 1248

SEQ ID NO: 1424 - protein, 45 aa, Arabidopsis thaliana; identical to SEQ ID NO: 1247

SEQ ID NO: 1425 - protein, 45 aa, Oryza sativa; identical to SEQ ID NO: 1250

SEQ ID NO: 1426 - protein, 45 aa, Oryza sativa; identical to SEQ ID NO: 1249

SEQ ID NO: 1427 - protein, 45 aa, Zea mays
VDFTEAEEDLVSRMHRLVGNRWEIIAGRIPGRTAEEVEMFWSKKY

SEQ ID NO: 1428 - protein, 45 aa, Zea mays; identical to SEQ ID NO: 1427

SEQ ID NO: 1429 - protein, 45 aa, Glycine max; identical to SEQ ID NO: 1246

SEQ ID NO: 1430 - protein, 45 aa, Arabidopsis thaliana; identical to SEQ ID NO: 1244

SEQ ID NO: 1431 - protein, 45 aa, Arabidopsis thaliana; identical to SEQ ID NO: 1245

SEQ ID NO: 1432 - protein, 45 aa, Glycine max; identical to SEQ ID NO: 1254

SEQ ID NO: 1433 - protein, 45 aa, Glycine max; identical to SEQ ID NO: 1253

SEQ ID NO: 1434 - protein, 45 aa, Glycine max; identical to SEQ ID NO: 1255

SEQ ID NO: 1435 - protein, 45 aa, Glycine max; identical to SEQ ID NO: 1255

SEQ ID NO: 1436 - protein, 45 aa, Glycine max; identical to SEQ ID NO: 1255

SEQ ID NO: 1437 - DNA, 20 bp, Artificial sequence
  Primer
  misc_feature (6)..(6): n is a, c, g, or t
  misc_feature (15)..(15): n is a, c, g, or t
  misc_feature (18)..(18): n is a, c, g, or t
cayccnathtaymgnggngt

SEQ ID NO: 1438 - DNA, 21 bp, Artificial sequence
  Primer
  misc_feature (3)..(3): n is a, c, g, or t
  misc_feature (6)..(6): n is a, c, g, or t
  misc_feature (12)..(12): n is a, c, g, or t
  misc_feature (18)..(18): n is a, c, g, or t
ggnarnarcatnccytcngcc

SEQ ID NO: 1439 - protein, 7 aa, Arabidopsis thaliana
HPIYRGV

SEQ ID NO: 1440 - protein, 8 aa, Arabidopsis thaliana
MAEGMLLP

What is claimed is:

1. A recombinant polynucleotide comprising a polynucleotide molecule selected from the group consisting of:
   (a) a polynucleotide molecule comprising the polynucleotide sequence of SEQ ID NO: 9,
   (b) a polynucleotide molecule encoding a polypeptide comprising the amino acid sequence of SEQ ID NO:10,
   (c) a polynucleotide molecule comprising a percent identity of at least 95% to the full-length polynucleotide sequence of SEQ ID NO:9, and
   (d) a polynucleotide molecule encoding a polypeptide comprising a percent identity of at least 95% to the full-length amino acid sequence of SEQ ID NO:10;
   wherein the polynucleotide molecule is operably linked to a heterologous promoter; and
   wherein the recombinant polynucleotide when comprised in a plant confers increased yield or drought tolerance relative to a control plant in which the recombinant polynucleotide is not comprised.

2. A transgenic plant transformed with the recombinant polynucleotide of claim 1.

3. The transgenic plant of claim 2, wherein the promoter is a constitutive, an inducible, or a tissue-enhanced promoter.

4. A cultured host cell of the transgenic plant of claim 2, wherein the cultured host cell comprises the recombinant polynucleotide.

5. A transgenic seed produced from the transgenic plant of claim 2, wherein the transgenic seed comprises the recombinant polynucleotide.

6. A method for producing a transgenic plant having an altered trait, wherein the method comprises the steps of:
   (a) providing the recombinant polynucleotide of claim 1;
   (b) introducing the recombinant polynucleotide into a plant; and
   (c) identifying the transgenic plant having an altered trait;
   wherein the altered trait comprises increased yield or drought stress tolerance relative to a control plant in which the recombinant polynucleotide has not been introduced.

7. The method of claim 6, further comprising:
   (d) crossing the transgenic plant with itself or another plant;
   (e) selecting a transgenic seed comprising said polynucleotide as a result of said crossing; and
   (f) growing a progeny plant from the transgenic seed, thus producing a transgenic progeny plant comprising said polynucleotide and having the altered trait.

8. The recombinant polynucleotide of claim 1, wherein the polynucleotide molecule has a percent identity of at least 95% to the full-length polynucleotide of SEQ ID NO:9.

9. The recombinant polynucleotide of claim 1, wherein the polynucleotide molecule encodes a polypeptide having a percent identity of at least 95% to the full-length amino acid sequence of SEQ ID NO:10.

10. The recombinant polynucleotide of claim 1, wherein the polynucleotide molecule encodes a polypeptide comprising an NAC (no apical meristem, *Arabidopsis* transcription activation factor 1/2, and cup-shaped cotyledon) domain.

11. The transgenic plant of claim 2, wherein the transgenic plant has an altered trait relative to a control plant that has not been transformed with the recombinant polynucleotide, wherein the altered trait comprises increased drought stress tolerance.

12. The recombinant polynucleotide of claim 1, wherein the polynucleotide molecule comprises the polynucleotide sequence of SEQ ID NO:9.

13. The recombinant polynucleotide of claim 1, wherein the polynucleotide molecule encodes a polypeptide comprising the amino acid sequence of SEQ ID NO:10.

* * * * *